(12) United States Patent
Zhou et al.

(10) Patent No.: US 11,859,193 B2
(45) Date of Patent: Jan. 2, 2024

(54) PLANTS WITH MODIFIED TRAITS

(71) Applicant: Commonwealth Scientific and Industrial Research Organisation, Acton (AU)

(72) Inventors: XueRong Zhou, Harrison (AU); Qing Liu, Giralang (AU); Anna El Tahchy, Moncrieff (AU); Srinivas Belide, Moncrieff (AU); Madeline Claire Mitchell, Turner (AU); Uday Kumar Divi, Moncrieff (AU); Thomas Vanhercke, Kaleen (AU); James Robertson Petrie, Goulburn (AU); Surinder Pal Singh, Downer (AU); Allan Graham Green, Cremorne Point (AU)

(73) Assignee: NUSEED GLOBAL INNOVATION LTD., Manchester (GB)

( * ) Notice: Subject to any disclaimer, the term of this patent is extended or adjusted under 35 U.S.C. 154(b) by 558 days.

(21) Appl. No.: 16/329,939

(22) PCT Filed: Sep. 1, 2017

(86) PCT No.: PCT/AU2017/050948
§ 371 (c)(1),
(2) Date: Mar. 1, 2019

(87) PCT Pub. No.: WO2018/039740
PCT Pub. Date: Mar. 8, 2018

(65) Prior Publication Data
US 2019/0185871 A1    Jun. 20, 2019

(30) Foreign Application Priority Data

Sep. 2, 2016  (AU) .............................. 2016903541
Sep. 6, 2016  (AU) .............................. 2016903577
Nov. 11, 2016 (AU) .............................. 2016904611
Jan. 6, 2017  (WO) ................ PCT/AU2017/050012
Jul. 13, 2017 (AU) .............................. 2017902756

(51) Int. Cl.
*C12N 15/82* (2006.01)
*C11B 1/10* (2006.01)
*A23K 10/12* (2016.01)
*A23K 10/30* (2016.01)
*C11C 3/00* (2006.01)
*C11B 1/04* (2006.01)
*C10L 1/02* (2006.01)
*C11B 1/06* (2006.01)
*C12Q 1/6895* (2018.01)

(52) U.S. Cl.
CPC .......... *C12N 15/8247* (2013.01); *A23K 10/12* (2016.05); *A23K 10/30* (2016.05); *C10L 1/026* (2013.01); *C11B 1/04* (2013.01); *C11B 1/06* (2013.01); *C11B 1/10* (2013.01); *C11C 3/003* (2013.01); *C12N 15/8218* (2013.01); *C12N 15/8251* (2013.01); *C12Q 1/6895* (2013.01); *C10L 2200/0476* (2013.01); *C10L 2200/0484* (2013.01); *C10L 2270/026* (2013.01); *C10L 2290/04* (2013.01); *C10L 2290/24* (2013.01); *C10L 2290/26* (2013.01); *C12Q 2600/13* (2013.01)

(58) Field of Classification Search
None
See application file for complete search history.

(56) References Cited

U.S. PATENT DOCUMENTS

| | | |
|---|---|---|
| 4,670,613 A | 6/1987 | Ruyter |
| 4,948,811 A | 8/1990 | Spinner |
| 4,992,605 A | 2/1991 | Craig |
| 5,500,361 A | 3/1996 | Kinney |
| 5,807,893 A | 9/1998 | Voelker |
| 5,912,416 A | 6/1999 | Weisker |
| 6,100,077 A | 8/2000 | Sturley |
| 6,344,548 B1 | 2/2002 | Farese |
| 6,432,684 B1 | 8/2002 | Mukerji |
| 6,998,516 B2 | 2/2006 | Brar |
| 7,001,771 B1 | 2/2006 | Morell |
| 7,045,326 B2 | 5/2006 | Cases |
| 7,109,392 B1 | 9/2006 | Broglie |
| 7,135,617 B2 | 11/2006 | Lardizabal |
| 7,244,599 B2 | 7/2007 | Tanner |

(Continued)

FOREIGN PATENT DOCUMENTS

| | | |
|---|---|---|
| EP | 1806398 | 7/2007 |
| EP | 1813664 A1 | 8/2007 |

(Continued)

OTHER PUBLICATIONS

Doerks et al., (TIG, 14:248-250, 1998).*

(Continued)

*Primary Examiner* — Vinod Kumar

(74) *Attorney, Agent, or Firm* — Gary J. Gershik

(57) ABSTRACT

The present invention relates, inter alia, to vegetative plant parts, such as from a *Sorghum* sp. and/or a *Zea mays* plant, which comprise a total fatty acid (TFA) content which comprises fatty acids esterified in the form of triacylglycerols (TAG) and fatty acids in the form of lipids other than TAG, wherein the vegetative plant parts comprise greatly increased levels of TFA, for example a TFA content of about 5% (w/w dry weight). The present invention also relates to the use of the vegetative plant parts as a feedstuff, and/or to produce a feedstuff, for animal consumption.

36 Claims, 20 Drawing Sheets

Figure 1:
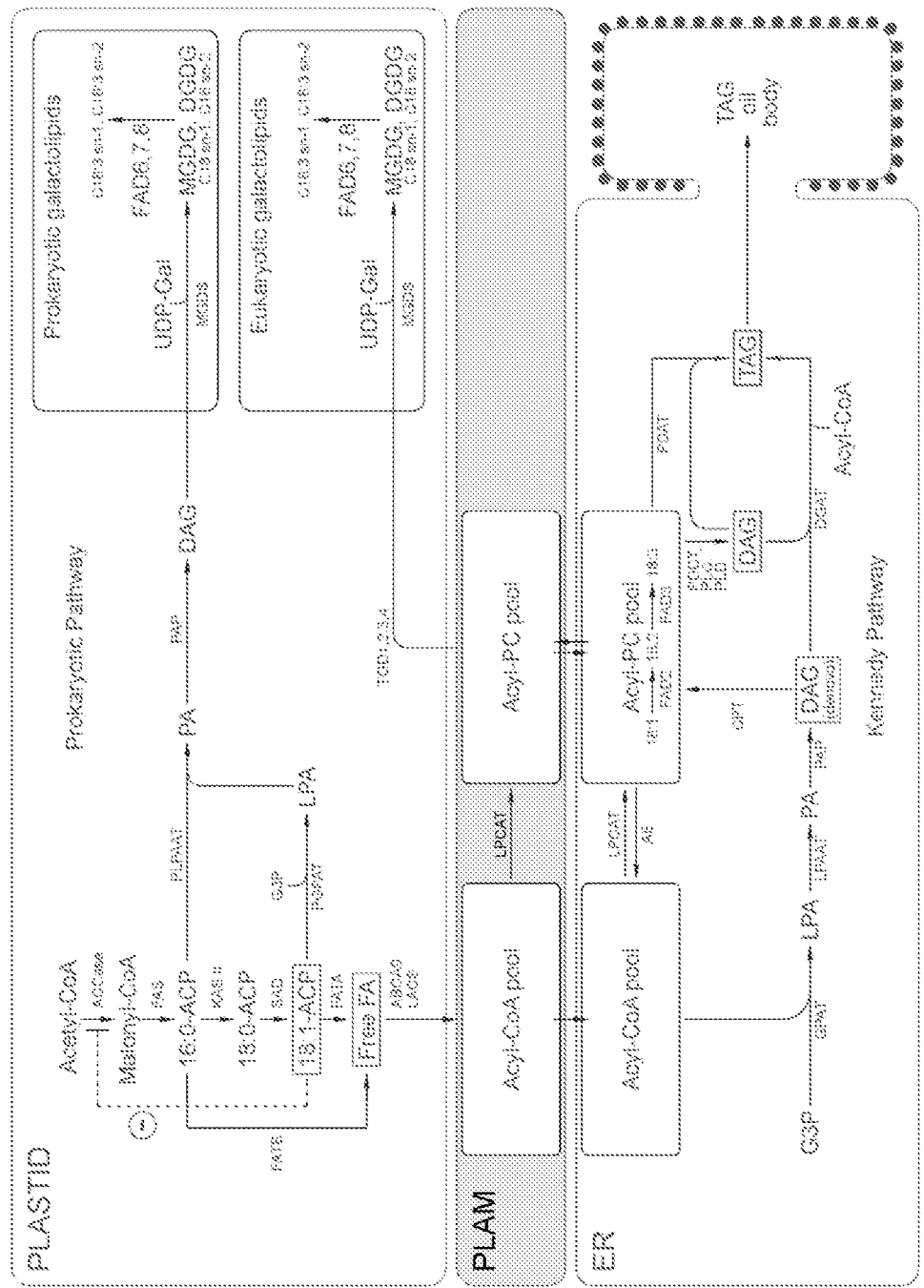

Specification includes a Sequence Listing.

(56) References Cited

U.S. PATENT DOCUMENTS

| | | |
|---|---|---|
| 7,417,176 B2 | 8/2008 | Lardizabal |
| 7,429,473 B2 | 9/2008 | Milcamps |
| 7,521,593 B2 | 4/2009 | Regina |
| 7,589,253 B2 | 9/2009 | Green |
| 7,619,105 B2 | 11/2009 | Green |
| 7,667,114 B2 | 2/2010 | Morell |
| 7,700,139 B2 | 4/2010 | Bird |
| 7,700,826 B2 | 4/2010 | Morell |
| 7,741,532 B2 | 6/2010 | Lardizabal |
| 7,790,955 B2 | 9/2010 | Li |
| 7,807,849 B2 | 10/2010 | Singh |
| 7,812,221 B2 | 10/2010 | Morell |
| 7,834,248 B2 | 11/2010 | Green |
| 7,834,250 B2 | 11/2010 | Singh |
| 7,888,499 B2 | 2/2011 | Regina |
| 7,892,803 B2 | 2/2011 | Tanner |
| 7,919,132 B2 | 4/2011 | Regina |
| 7,932,438 B2 | 4/2011 | Singh |
| 7,932,440 B2 | 4/2011 | Reid |
| 7,993,686 B2 | 8/2011 | Bird |
| 8,049,069 B2 | 11/2011 | Wu |
| 8,071,341 B2 | 12/2011 | Singh |
| 8,106,226 B2 | 1/2012 | Singh |
| 8,115,087 B2 | 2/2012 | Regina |
| 8,158,392 B1 | 4/2012 | Singh |
| 8,178,759 B2 | 5/2012 | Morell |
| 8,188,336 B2 | 5/2012 | Li |
| 8,269,082 B2 | 9/2012 | Millar |
| 8,288,572 B2 | 10/2012 | Singh |
| 8,501,262 B2 | 8/2013 | Bird |
| 8,530,724 B2 | 9/2013 | Whitelaw |
| 8,535,917 B2 | 9/2013 | Singh |
| 8,575,377 B2 | 11/2013 | Singh |
| 8,716,555 B2 | 5/2014 | Liu |
| 8,735,111 B2 | 5/2014 | Vanhercke |
| 8,778,644 B2 | 5/2014 | Singh |
| 8,853,432 B2 | 5/2014 | Singh |
| 8,809,026 B2 | 8/2014 | Vanhercke |
| 8,809,559 B2 | 8/2014 | Petrie |
| 8,816,106 B2 | 8/2014 | Damcevski |
| 8,921,652 B2 | 12/2014 | Liu |
| 9,057,075 B2 | 6/2015 | Liu |
| 9,061,992 B2 | 6/2015 | Vanhercke |
| 9,127,288 B2 | 9/2015 | Petrie |
| 9,512,438 B2 | 12/2016 | Vanhercke |
| 2002/0104124 A1 | 8/2002 | Green |
| 2004/0221335 A1 | 11/2004 | Shewmaker |
| 2005/0106697 A1 | 5/2005 | Cases |
| 2005/0193446 A1 | 9/2005 | Zou |
| 2005/0262588 A1 | 11/2005 | Dehesh |
| 2006/0053512 A1 | 3/2006 | Bao |
| 2006/0094088 A1 | 5/2006 | Picataggio |
| 2006/0206963 A1 | 9/2006 | Voelker |
| 2008/0268539 A1 | 10/2008 | Singh |
| 2008/0289248 A1 | 11/2008 | Gao |
| 2008/0311580 A1 | 12/2008 | Abrahams |
| 2009/0061492 A1 | 8/2009 | Benning |
| 2009/0308041 A1 | 12/2009 | Whitelaw |
| 2010/0105078 A1 | 4/2010 | Benning |
| 2010/0184130 A1 | 7/2010 | Koprowski |
| 2010/0192457 A1 | 8/2010 | Tsurutani |
| 2010/0221400 A1 | 9/2010 | Chapman |
| 2010/0257639 A1 | 10/2010 | Bruccoleri |
| 2011/0015415 A1 | 1/2011 | Singh |
| 2011/0045127 A1 | 2/2011 | Rai |
| 2011/0054198 A1 | 3/2011 | Singh |
| 2011/0126325 A1 | 5/2011 | Zhou |
| 2011/0190521 A1 | 8/2011 | Damcevski |
| 2011/0201065 A1 | 8/2011 | Singh et al. |
| 2011/0218348 A1 | 9/2011 | Zhou |
| 2011/0223311 A1 | 9/2011 | Liu |
| 2011/0229623 A1 | 9/2011 | Liu |
| 2011/0281818 A1 | 11/2011 | Jenkins et al. |
| 2011/0314725 A1 | 12/2011 | Petrie |
| 2012/0016144 A1 | 1/2012 | Petrie et al. |
| 2012/0029252 A1 | 2/2012 | Lissianski |
| 2012/0041218 A1 | 2/2012 | Singh et al. |
| 2012/0055077 A1 | 3/2012 | Savage |
| 2012/0114770 A1 | 5/2012 | Regina |
| 2012/0129805 A1 | 5/2012 | Li |
| 2012/0208198 A1 | 8/2012 | Bogs et al. |
| 2012/0237949 A1 | 9/2012 | Benning |
| 2012/0278951 A1 | 11/2012 | Roberts |
| 2013/0059351 A1 | 3/2013 | Tojo |
| 2013/0115362 A1 | 5/2013 | Regina |
| 2013/0164798 A1 | 6/2013 | Vanhercke |
| 2013/0247451 A1 | 9/2013 | Vanhercke |
| 2013/0288318 A1 | 10/2013 | Wood |
| 2014/0020133 A1 | 1/2014 | Benning |
| 2014/0031573 A1 | 1/2014 | Shanklin |
| 2014/0120225 A1 | 5/2014 | Whitelaw |
| 2014/0228585 A1 | 8/2014 | Benning |
| 2014/0256006 A1 | 9/2014 | Vanhercke |
| 2014/0371477 A1 | 12/2014 | Wood |
| 2015/0037457 A1 | 2/2015 | Vanhercke |
| 2015/0176017 A1 | 6/2015 | Liu |
| 2015/0267216 A1 | 9/2015 | Vanhercke |
| 2015/0330717 A1* | 11/2015 | Aoki ............... F28D 15/0233 165/104.26 |
| 2015/0337017 A1* | 11/2015 | Xu ............... C12N 15/8247 800/281 |
| 2015/0353863 A1 | 12/2015 | Petrie |
| 2016/0002566 A1 | 1/2016 | Vanhercke |
| 2016/0002651 A1* | 1/2016 | Xu ............... C12N 15/8247 800/306 |
| 2017/0037320 A1 | 2/2017 | Vanhercke |

FOREIGN PATENT DOCUMENTS

| | | |
|---|---|---|
| EP | 1837397 | 9/2007 |
| EP | 1944375 | 7/2008 |
| JP | H06-504439 | 8/1992 |
| JP | H10-509863 | 3/1996 |
| JP | 2003-508061 | 3/2001 |
| WO | WO 1998/55631 | 12/1998 |
| WO | WO 1999/049050 | 9/1999 |
| WO | WO 1999/67268 | 12/1999 |
| WO | WO 1999/67403 | 12/1999 |
| WO | WO 2000/01713 | 1/2000 |
| WO | WO 2000/011176 | 3/2000 |
| WO | WO 2000/32756 | 6/2000 |
| WO | WO 2000/32793 | 6/2000 |
| WO | WO 2000/36114 | 6/2000 |
| WO | WO 2000/60095 | 10/2000 |
| WO | WO 2000/66750 | 10/2000 |
| WO | WO 2000/66749 | 11/2000 |
| WO | WO 2001/070777 | 9/2001 |
| WO | WO 2002/004648 | 1/2002 |
| WO | WO 2002/072775 | 9/2002 |
| WO | WO 2004/011671 | 2/2004 |
| WO | WO 2004/042014 | 5/2004 |
| WO | WO 2005/003322 | 1/2005 |
| WO | WO 2005/063988 | 5/2005 |
| WO | WO 2005/103253 | 11/2005 |
| WO | WO 2006/007432 | 1/2006 |
| WO | WO 2007/045019 | 4/2007 |
| WO | WO 2007/101273 | 9/2007 |
| WO | WO 2007/103738 | 9/2007 |
| WO | WO 2007/107738 | 9/2007 |
| WO | WO 2007/141257 | 12/2007 |
| WO | WO 2007/149583 | 12/2007 |
| WO | WO 2008/006207 | 1/2008 |
| WO | WO 2008/060595 | 5/2008 |
| WO | WO 2008/025068 | 6/2008 |
| WO | WO 2008/068498 A2 | 6/2008 |
| WO | WO 2008/119082 | 10/2008 |
| WO | WO 2008/130248 | 10/2008 |
| WO | WO 2008/147935 | 12/2008 |
| WO | WO 2008/157226 | 12/2008 |
| WO | WO 2008/157827 | 12/2008 |
| WO | WO 2009/027335 | 3/2009 |
| WO | WO 2009/073822 | 6/2009 |
| WO | WO 2009/085169 | 7/2009 |
| WO | WO 2003/078639 | 9/2009 |

(56) References Cited

FOREIGN PATENT DOCUMENTS

| WO | WO 2009/129582 | 10/2009 | |
|---|---|---|---|
| WO | WO 2009/143397 | 11/2009 | |
| WO | WO 2009/143398 | 11/2009 | |
| WO | WO 2009/143401 | 11/2009 | |
| WO | WO 2009/147409 | 12/2009 | |
| WO | WO 2010/009499 | 1/2010 | |
| WO | WO 2010/009500 | 1/2010 | |
| WO | WO 2010/057246 | 5/2010 | |
| WO | WO 2010/088426 | 8/2010 | |
| WO | WO 2011/048119 A2 | 4/2011 | |
| WO | WO 2011/053169 | 5/2011 | |
| WO | WO 2011/062748 | 5/2011 | |
| WO | WO 2011/082253 | 7/2011 | |
| WO | WO 2011/123897 A1 | 10/2011 | |
| WO | WO 2011/127118 | 10/2011 | |
| WO | WO 2012/000033 A1 | 1/2012 | |
| WO | WO 2012/000026 | 5/2012 | |
| WO | WO 2012/092644 A1 | 7/2012 | |
| WO | WO 2013/003608 | 1/2013 | |
| WO | WO 2013/022353 | 2/2013 | |
| WO | WO 2013/033369 A2 | 3/2013 | |
| WO | WO 2013/096562 | 6/2013 | |
| WO | WO 2013/096993 A1 | 7/2013 | |
| WO | WO 2013/185184 | 12/2013 | |
| WO | WO 2014/068437 | 5/2014 | |
| WO | WO 2014/068438 | 5/2014 | |
| WO | WO 2014/068439 | 5/2014 | |
| WO | WO 2014/100467 A1 | 6/2014 | |
| WO | WO 2016/004473 A1 | 1/2016 | |
| WO | WO-2016004473 A1 * | 1/2016 | ............... C11C 3/10 |

OTHER PUBLICATIONS

Smith et al. (Nature Biotechnology, 15:1222-1223, 1997).*
Bork et al. (TIG, 12:425-427, 1996).*
Gutterson (HortScience 30:964-966,1995).*
Bruening (Proc. Natl. Acad. Sci., 95:13349-13351, 1998).*
Elomaa et al. (Molecular Breeding, 2:41-50, 1996).*
Colliver et al. (Plant molecular Biology, 35:509-522, 1997).*
Emery et al. (Current Biology 13:1768-1774, 2003).*
Nunes et al. (Planta 224:125-132; 2006).*
Arziman et al. (Nucleic Acids Research, 33:582-588, 2005).*
Bonawitz et al.,(Annu. Rev. Genet. 44: 337-363, 2010).*
Paul et al., Plant Cell Reports; 35:1417-1427; 2016.*
Moran ('Making quality silage', Tropical dairy farming: feeding management for small holder dairy farmers in the humid tropics, Landlinks Press, 2005, chapter 9, pp. 83 to 97).*
Nov. 14, 2017 International Search Report issued in connection with International Application No. PCT/AU2017/050948.
Nov. 14, 2017 Written Opinion issued in connection with International Application No. PCT/AU2017/050948.
Divi et al., Plant & Cell Physiology (2015) 57(1): 125-137.
John Moran, Tropical Dairy Farming: Feeding Management for Small Holder Dairy Farmers in Humid Topics 83-97 (2005).
Feb. 28, 2021 Partial European Search Report issued in connection with corresponding European Patent Application No. 17844702.5.
Jan. 20, 2021 Office Action issued in connection with corresponding Russian Patent Application No. 2019109455.
Kelly, A.A. et al. "The Sugar-Dependent1 Lipase Limits Triacylglycerol Accumulation in Vegetative Tissues of *Arabidopsis*", Plant Physiology, 162: 1282-1289 (Jul. 2013).
Vanhercke, T. et al. "Metabolic engineering of biomass for high energy density: oilseed-like triacylglycerol yields from plant leaves", Plant Biotechnology, 12: 231-239 (2014).
Sep. 6, 2021 Office Action issued in relation to the counterpart Ukrainian Patent Application No. a201903090 including English translation thereof.
Apr. 20, 2021 Request for Further Processing and Response to Communication under Rule 70(2) and Rule 70a(2) EPC filed in connection with European Patent Application No. 17844702.5.
Jun. 17, 2021 Office Action and Search Report issued in connection with corresponding Russian Patent Application No. 2019109455 including English language translation thereof.
Jul. 1, 2022 Office Action and Search Report issued in connection with corresponding Argentinian Patent Application No. 20170102448.
Protein Sources for the Animal Feed Industry. Proceedings of the Food and Agriculture Organization of the United Nations Protein Sources, Expert Consultation and Workshop Bangkok, Apr. 29, 2002 Uto May 3, 2002.
Tan, H., et al. (2011). Enhanced Seed Oil Production in Canola by Conditional Expression of *Brassica napus* Leafy Cotyledon1 (BnLECI) and LEC1-LIKE (BnL1L) in Developing Seeds 1.
Sep. 16, 2022 Office Action issued in connection with corresponding Russian Federation Patent Application 2019109455 including English language thereof.
U.S. Appl. No. 13/093,252, filed Apr. 25, 2011, Singh.
Abdullah, R., Cocking, E. C., & Thompson, J. A. (Dec. 1986). Efficient plant regeneration from rice protoplasts through somatic embryogenesis. Biotechnology, 4, 1087-1090.
Agarwal et el. (2003) "Cottonseed Oil Quality, Utilization and Processing" CICR Technical Bulletin No. 25, pp. 1-16.
Aghoram, K., Wilson, R.F., Burton, J.W., Dewey, R.E. 2006. A mutation in a 3-keto-acyl-acp synthase ii gene is associated with elevated palmitic acid levels in soybean seeds. Crop Sci. 46:2453-2459.
Akagi et al. (1995) Nucleotide Sequence of a Stearoyl-Acel carrier Protein Desaturase cDNA from Developing Seeds of Rice. Plant Physiol. 108, 845-846.
Alemanno et al. (2008) "Characterization of leafy cotyledonl-like during embryogenesis in *Theobroma cacao* L." Planta 227:853-866.
Almeida and Allshire, (2005) "RNA silencing and genome regulation." Trends in Cell Biology, 15:251-258.
Alonso et al. (2010) "Catalytic conversion of biomass to biofuels" Green Chem. 12:1493-1513.
Anai et al. (2003) Improvement of rice (*Oryza sativa* L.) seed oil quality through introduction of a soybean microsomal omega-3 fatty acid desaturase gene. Plant Cell Rep. 21,988-992.
Andrianov et al. (2010) "Tobacco as a production platform for biofuel: overexpression of *Arabidopsis* DGAT and LEC2 genes increases accumulation and shifts the composition of lipids in green biomass" Plant Biotech. J. 8:277-287.
Apr. 15, 2016 Response to Office Action dated Jan. 15, 2016, filed in connection with U.S. Appl. No. 14/729,754, filed Jun. 3, 2015.
Apr. 17, 2018 Second Office Action issued in connection with Mexican Patent Application MX/a/2014/007964.
Apr. 20, 2018 Examination Report issued in connection with Philippine Patent Application No. 1/2014/501474.
Apr. 26, 2017 Office Action, issued in connection with Ukrainian Patent Application No. 201408514, including English language translation.
Apr. 28, 2015 Notice of Allowance, issued in connection with U.S. Appl. No. 14/283,728, filed May 21, 2014.
Apr. 30, 2013 Office Action, issued in connection with U.S. Appl. No. 13/725,404, filed Dec. 21, 2012.
Ascherio and Willett (1997) "Health effects of trans fatty acids" Am. J. Clin. Nutr. 66: 1006S-1010S.
Aug. 1, 2018 Second Office Action issued in connection with Ukrainian Patent Application No. a 2014 08514, including English language translation thereof.
Aug. 17, 2016 Response to the Rules 70(2) and 70a(2) Communication, filed in connection with European patent application 12863568. 7.
Aug. 17, 2018 Office Action issued in connection with Canadian Patent Application No. 2,860,434.
Aug. 20, 2018 Response to the dated Apr. 20, 2018 Office Action issued in connection with Philippine Patent Application No. 1-2014-501474.
Aug. 22, 2016 Second Examination Report, issued in connection with Australian Patent Application No. 2013205482.
Aug. 27, 2015 First Office Action, issued in connection with Chinese Patent Application No. 201280070729.5, including English language translation.

(56) References Cited

OTHER PUBLICATIONS

Aug. 8, 2016 Response to First Examination Report, filed in connection with Australian Patent Application No. 2013205482.
Awai et al., (2006) "A phosphatidic acid-binding protein of the chloroplast inner envelope membrane involved in lipid trafficking" PNAS 103(28):10817-22.
Bao and Ohlrogge, (1999) "Supply of Fatty Acid is One Limiting Factor in the Accumulation of Triacylglycerol in Developing Embryos." Plant Physiology, 120:1057-1062.
Barthole et al. (2011) "Controlling lipid accumulation in cereal grains" Plant Sci. 185-186:33-39.
Baumlein, H., et al., (1991) "A Novel Seed Protein Gene From Vicia faba is Developmentally Regulated in Transgenic Tobacco and *Arabidopsis* Plants," Molecular And General Genetics, 225(3): 459-467.
Benning, (2008) "A role for lipid trafficking in chloroplast biogenesis" Progress in Lipid Research 47, 381-389.
Benning, (2009) "Mechanisms of Lipid Transport Involved in Organelle Biogenesis in Plant Cells" Annu. Rev. Cell Dev. Biol. 25:71-91.
Bligh and Dyer (1959) "A Rapid Method of Total Lipid Extraction and Purification" Canadian Journal of Biochemistry and Physiology 37:911-917.
Bligh and Dyer, (1959) "Orange-red Flesh in Cod and Haddock" J. Fish. Res. Bd. Canada, 16(4):449-452.
Boggs et al. (1964) "Relation of Hexanal in Vapor Above Stored Potato Granules to Subjective Flavor Extimates." J. Food Sci. 29:487-489.
Bonanome and Grundy (1988) "Effect of Dietary Stearic Acid on Plasma Cholesterol and Lipoprotein Levels" N. Engl. Med. 318: 1244-1248.
Bouvier-Nave et al. (2000) "Expression in yeast and tobacco of plant cDNAs encoding acyl CoA:diacylglycerol acyltransferase" European Journal of Biochemistry/FEBS 267:85-96.
Brandt et al., (1985) "Primary Structure of a B1 Hordein Gene from Barley" Carlsberg Res. Commun., 50:333-345.
Broun et al. (1998) "A bifunctional oleate 12-hydroxylase: desaturase from Lesquerella fenleri." The Pant Journal, 13(2):201-210.
Buhr et al. (2002) "Ribozyme termination of RNA transcripts down-regulate seed fatty acid genes in transgenic soybean" Plant J. 30: 155-163.
Burgal et al., (2008) "Metabolic engineering of hydroxy fatty acid production in plants: RcDGAT2 drives dramatic increases in ricinoleate levels in seed oil" Plant Biotechnology Journal 6(8):819-831.
Cao et al. (2007) "Catalytic properties of MGAT3, a putative triacylglycerol synthase" Journal of Lipid Research (48): 583-591.
Cao et al., (2003) "Properties of the Mouse Intestinal Acyl-CoA:Monoacylglycerol Acyltransferase, MGAT2." The Journal of Biological Chemistry, 278(28)25657-25669.
Cases et al., (1998) "Identification of a gene encoding an acyl CoA:diacylglycerol acyltransferase, a key enzyme in triacylglycerol synthesis" PNAS 95:13018-13023.
Cases et al., J. Biol. Chem. (2001) "Cloning of DGAT2, a Second Mammalian Diacylglycerol Acyltransferase, and Related Family Members" 276(42):38870-38876.
Cernac and Benning (2004) "Wrinkled1 encodes an AP2/EREB domain protein involved in the control of storage compound biosynthesis in *Arabidopsis*" Plant J. 40:575-585.
Champagne et al. (1995) "Stabilization of Brown Rice Products Using Ethanol Vapors as an Antioxidant Delivery System" Cereal Chem 72:255-258.
Chang et al., (1978) "Chemical Reactions Involved in the Deep-Fat Frying of Foods." Journal of American Oil Chemists' Society, 55:718-727.
Chapman et al. (2001) "Transgenic Cotton Plants with Increased Seed Oleic Acid Content" Journal of American Chemists' Chemistry; vol. 78 No. 9, 941-947.
Chappell et al. (1998) "Vegetable Oil Production: Industry Profile," Preliminary Final Report, EPA Contract # 68-D4-0099, RTU Project # 7018-54, p. 1-1-5-26, retrieved from http://www.epa.gov/ttnecas1/regdata/IPs/Vegetable%20Oil_IP.pdf Apr. 23, 2013.
Cheng et al., (2003) "Identification of Acyl Coenzyme A:Monoacylglycerol Acyltransferase 3, an Intestinal Specific Enzyme Implicated in Dietary Fat Absorption." The Journal of Biological Chemistry, 278(126):13611-13614.
Cherry, (1983) "Cottonseed Oil" J. Am. Oil Chem. Soc. 60: 360-367.
Choudhury et al. (1980) "Lipids in Developing and Mature Rice Grain" Phytochemistry 19:1063-1069.
Cicero et al. (2001) "Rice bran oil and [gamma]-oryzanol in the treatment of hyperlipoproteinaemias and other conditions" Phytotherapy Research; vol. 15 No. 4, 277-289.
Clapp et al., (1993) "The 16-Kilodalton N-Terminal Fragment of Human Prolactin is a Potent Inhibitor of Angiogenesis" Endocrinology, 133(3):1292-1299.
Colot et al., (1987) "Localization of sequences in wheat endosperm protein genes which confer tissue-specific expression in tobacco" The EMBO Journal, 6(12):3559-3564.
Comai et al., (2004) "Efficient discovery of DNA polymorphisms in natural populations by Ecotilling" The Plant Journal, 37:778-786.
Connolly et al. (1998) GenBank Accession No. AC004236, NCBI, pp. 1-11.
Dec. 27, 2016 Examination Report, issued in connection with Russian Federation Patent Application No. 2014131059, including English Language Translation.
Dec. 31, 2013 Office Action, issued in connection with U.S. Appl. No. 13/725,404, filed Dec. 21, 2012.
Domergue et al., (2005) "In vivo characterization of the first acyl-CoA Δ6-desaturase from a member of the plant kingdom, the microalga *Ostreococcus tauri*." Biochem J. 389, 483-490.
Dougherty et al. (1995). Effects of diets containing high or low amounts of stearic acid on plasma lipoprotein fractions and fecal fatty acid excretion of men. Am. J. Clin. Nutr. 61:1120-1128.
Dowd et al., (2004) "Gene Expression Profile Changes in Cotton Root and Hypocotyl Tissues in Response to Infection with *Fusarium oxysporum* f. sp. *vasinfectum*" Molecular Plant—Microbe Interactions. 17: 654-667.
Dubois et al. (2007) "Fatty acid profiles of 80 vegetable oils with regard to their nutritional potential" European Journal of Lipid Science Technology 109(7):710-732.
Dulermo and Nicaud (2011) "Involvement of the G3P shuttle and β-oxidation pathway in the control of TAG synthesis and lipid accumulation in Yarrowia lipolytica" Metab. Eng. 13:482-491.
Durrett et al. (2008) "Plant triacylglycerols as feedstocks for the production of biofuels" Plant J. 54:593-607.
Eastmond, (2006) "Sugar-Dependent1 Encodes a Patatin Domain Triacylglycerol Lipase That Initiates Storage Oil Breakdown in Germinating *Arabidopsis* Seeds" The Plant Cell, vol. 18, 665-675.
Endalew et al. (2011) "Inorganic heterogeneous catalysts for biodiesel production from vegetable oils" Biomass and Bioenergy 35:3787-3809.
English translation of May 7, 2018 Office Action, issued in connection with Japanese Patent No. 2014-549274.
English translation of the Aug. 23, 2017 Office Action, issued in connection with Mexican Patent Application No. MX/a/2014/007964.
English translation of the Oct. 24, 2017 Office Action, issued in connection with Russian Patent Application No. 2014131059.
English translation of the Oct. 24, 2017 Office Action, issued in connection with Chinese Patent Application No. 201280070729.5.
Feb. 18, 2014 Notice of Allowance, issued in connection with U.S. Appl. No. 13/725,404, filed Dec. 21, 2012.
File History for U.S. Patent Publication No. 2009-0308041, Whitelaw et al., Dec. 17, 2009 (U.S. Appl. No. 12/309,276, filed Jul. 6, 2009).
File History of U.S. Patent Application Publication No. 2011/0314725, Petrie et al., published Dec. 29, 2011 (U.S. Appl. No. 13/171,032, filed Jun. 28, 2011).
File History of U.S. Patent Application Publication No. 2013/0164798, Vanhercke et al., published Jun. 27, 2013 (U.S. Appl. No. 13/841,641, filed Mar. 15, 2013).

(56) References Cited

OTHER PUBLICATIONS

File History of U.S. Patent Publication No. 2011-0223311, Liu et al., published Sep. 15, 2011 (U.S. Appl. No. 13/011,773, filed Jan. 21, 2011).
File History of U.S. Patent Publication No. 2011-0229623, Liu et al., Sep. 22, 2011 (U.S. Appl. No. 13/011,779, filed Jan. 21, 2011).
Folch et al., (1957) "A Simple Method for the Isolation and Purification of total Lipides From Animal Tissues" J. Biol. Chem. 226: 497.
Fuller et al., (1966) "A Gas Chromatographic Method for Continuous Accelerated Study of O2 Uptake in Fats" JAOCS. 43: 477-478.
Ghosal et al. (2007) "*Saccharomyces cerevisiae* phospholipid-:diacylglycerol acyl transferase (PDAT) devoid of its membrane anchor region is a soluble and active enzyme retaining its substrate specificities" Biochimica et Biophysica Acta 1771:1457-1463.
Goffman et al., (2003) "Genetic Diversity for Lipid Content and Fatty Acid Profile in Rice Bran," Journal of the American Oil Chemists' Society 80:485-490.
Gong and Jiang (2011) "Biodiesel production with microalgae as feedstock: from strains to biodiesel" Biotechnol. Lett. 33:1269-1284.
Greenwell et al. (2010) "Placing microalgae on the biofuels priority list: a review of the technological challenges" J. R. Soc. Interface 7:703-726.
Ha (2005) "Bioactive components in rice bran oil improve lipid profiles in rats fed on high-cholesterol diet" Nutrition research 25, 597-606.
Haseloff, J. and Gerlach, W.L., (1988) "Simple RNA Enzymes With New and Highly Specific Endoribonuclease Activities," Nature, 334: 585-591.
Henikoff et al., (2004) "Tilling. Traditional Mutagenesis Meets Functional Genomics." Plant Physiology, 2004, 135:630-636.
Hu et al. (1997) "Dietary Fat Intake and the Rist of Coronary Heart Disease in Women." N. Engl. J. Med. 337: 1491-1499.
Hutchins et al., (1968) "A New Process for the Selective Hydrogenation Cyclopropenoids in Cottonseed Oil" Journal of American Oil Chemists Society 45: 397-399.
International Search Report and Written Opinion of the International Searching Authority dated Apr. 8, 2013 in connection with PCT International Patent Application No. PCT/AU2012/001598, which claims priority of U.S. Appl. No. 61/718,563, filed Oct. 25, 2012 and U.S. Appl. No. 61/580,590, filed Dec. 27, 2011.
Jain et al., (2000) "Enhancement of seed oil content by expression of glycerol-3-phosphate acyltransferase genes" Biochemical Society Transactions 28(6):958-961.
Jako et al., (2001) "Seed-Specific Over-Expression of an *Arabidopsis* cDNA Encoding a Diacylglycerol Acyltransferase Enhances Seed Oil Content and Seed Weight" Plant Physiology 126:861-874.
James et al. (2010) "Disruption of the *Arabidopsis* CGI-58 homologue produces Chanarin-Dorfman-like lipid droplet accumulation in plants," 107(41):17833-17838 and supporting information pp. 1-3.
Jan. 13, 2017 Examination Report, issued in connection with Chilean Patent Application No. 201401715, including English Language Translation.
Jan. 15, 2016 Office Action, issued in connection with U.S. Appl. No. 14/729,754, filed Jun. 3, 2015.
Jan. 23, 2015 First Examination Report, issued in connection with Australian Patent Application No. 2013205482.
Jan. 27, 2014 Response to Office Action dated Dec. 31, 2013, filed in connection with U.S. Appl. No. 13/725,404, filed Dec. 21, 2012.
Jennings and Akoh (2000) "Lipase-Catalyzed Modification of Rice Bran Oil to Incorporate Capric Acid." Journal of Agricultural and Food Chemistry, 48:4439-4443.
Jolivet et al. (2004) "Protein composition of oil bodies in *Arabidopsis thaliana* ecotype WS" Plant Physiology and Biochemistry 42: 501-509.
Jones et al. (1995) "Palmitoyl-Acyl Carrier Protein (ACP) Thioesterase and the Evolutionary Origin of Plant Acyl-ACP Thioesterases." Plant Cell 7: 359-371.

Jul. 6, 2016 Notice of Allowance, issued in connection with U.S. Appl. No. 14/729,754, filed Jun. 3, 2015.
Jul. 8, 2013 Response to Office Action dated Apr. 30, 2013, in connection with U.S. Appl. No. 13/725,404, filed Dec. 21, 2012.
Jun. 19, 2013 Examiner Interview Summary, issued in connection with U.S. Appl. No. 13/725,404, filed Dec. 21, 2012.
Jun. 20, 2017 Communication from the EPO Examining Division, issued in connection with European Patent Application No. 12863568.7.
Jun. 28, 2016 Office Action, issued in connection with Chinese Patent Application No. 201280070729.5, including English language translation.
Kargiotidou et al., (2008) "Low temperature and light regulate delta 12 fatty acid desaturases (FAD2) at a transcriptional level in cotton (*Gossypium hirsutum*)" Journal of Experimental Botany 2008 59(8): 2043-2056.
Karmakar et al. (2010) "Properties of various plants and animals feedstocks for biodiesel production" Bioresource Technology 101:7201-7210.
Kelly et al., (2011) "Seed Storage Oil Mobilization is Important but Not Essential for Germination or Seedling Establishment in *Arabidopsis*" Plant Physiology, vol. 157, pp. 866-875.
Kelly et al (2013). Suppression of the Sugar-Dependent 1 triacylglycerol lipase family during seed development enhances oil yield in oilseed rape (*B rassica napus* L.). Plant Biotech. J. 11:355-361.
Kim et al., (1999) GenBank Accesion No. AF213480, NCBI, p. 1.
Kinney (1996) "Development of Genetically Engineered Soybean Oils for Food Applications." J. Food Lipids 3: 273-292.
Klahre et al. (2002) "High molecular weight RNAs and small interfering RNAs induce systemic posttranscriptional gene silencing in plants." PNAS 99(18): 11981-11986.
Kodama et al. (1997) "Structure, chromosomal location and expression of a rice gene encoding the microsome ω-3 fatty acid desaturase." Plant Molecular Biology 33:493-502.
Kohno-Murase et al. (2006) "Production of trans-10, cis-12 conjugated linoleic acid in rice." Transgenic Research 15:95-100.
Kozeil et al. (1996) "Optimizing expression of transgenes with an emphasis on post-transcriptional events." Plant Molecular Biology, 32:393-405.
Langridge et al., Trends in genetic and genome analysis in wheat: a review. Aust. J. Agric. Res., 2001, 52:1043-1077.
Lardizabal et al. (2001) "DGAT2 is a New Diacylglycerol Acyltransferase Gene Family" J. Biol. Chem. 276:38862-3886.
Lardizabal et al. (2008) "Expression of Umbelopsis ramanniana DGAT2A in Seed Increases Oil in Soybean" Plant Physiol. 148: 89-96.
Lee, M., et al., (1998) "Identification of Non-Heme Diiron Proteins That Catalyze Triple Bond and Epoxy Group Formation," Science, 280(5365): 915-918.
Lemieux B., (2000) "High Throughput Single Nucleotide Polymorphism Genotyping Technology." Current Genomics, 2000, 1:301-311.
Leonard et al. (1997) "Cuphea wrightii thioesterases have unexpected broad specificities on saturated fatty acids." Plant Molecular Biology, vol. 34, Issue 4: 669-679.
Li et al., (1997) "Comparison of promoters and selectable marker genes for use in Indica rice transformation." Molecular Breeding, 3:1-14.
Liu et al. (1997) EMBL Nucleotide Sequence Database as X97016.
Liu et al. (1999) "Molecular cloning and expression of a cDNA encoding a microsomal ω-6 fatty acid desaturase from cotton (*Gossypium hirsutum*)" Aust. J. Plant Physiol. 26:101-106.
Liu et al. (2002) "High-Oleic and High-Stearic Cottonseed Oils : Nutritionally Improved Cooking Oils Developed Using Gene Silencing." J. Am. Coll. Nutr. 21: 205S-211S.
Liu et al. (2010) "Increasing Seed Mass and Oil Content in Transgenic Arabidopsis by the Overexpression of wril-like gene from *Brassica napus*" Plant Physiology and Biochemistry 48(1): 9-15.
Liu et al. (2010) "Producing biodiesel from high free fatty acids waste cooking oil assisted by radio frequency heating" Fuel 89:2735-2740.

(56) References Cited

OTHER PUBLICATIONS

Liu et al., (1999) "Cloning and Sequence Analysis of a Novel Member (Accession No. Y10112) of the Microsomal ω-6 Fatty Acid Desaturase Family from Cotton" Plant Physiol. (PGR 99-063) 120: 339.

Liu et al., (2000) "Genetic modification of cotton seed oil using inverted-repeat gene-silencing techniques." Biochemical Society Transations, 28(6):927-929.

Liu et al., (2002) "High-Stearic and High-Oleic Cottonseed Oils Produced by Hairpin RNA-Mediated Post-Transcriptional Gene Silencing." Plant Physiology, 129(4):1732-1743.

Liu et al., (2005) GenBank Accession No. AY574036.

Liu et al., (2005) GenBank Accession No. AY574037.

Liu et al., (2005) GenBank Accession No. AY574038.

Lu et al. (1993) "High efficiency retroviral mediated gene transduction into single isolated immature and replatable CD343+ hematopoietic stem/progenitor cells from human umbilical cord blood." J. Exp. Med., 178, 2089-2096.

Lu et al., (2011) "New frontiers in oilseed biotechnology: meeting the global demand for vegetable oils for food, feed, biofuel, and industrial applications" Current Opinion in Biotechnology, 22:252-259.

Maher and Bressler (2007) "Pyrolysis of triglyceride materials for the production of renewable fuels and chemicals" Bioresource Technology 98:2351-2368.

Mar. 25, 2015 First Examination Report, issued in connection with New Zealand Patent Application No. 627107.

Mar. 3, 2017 Third Office Action, issued in connection with Chinese Patent Application 201280070729.5, including English language translation.

Mensink and Katan (1990) "Effect of Dietary Trans Fatty Acids on High-Density and Low-Density Lipoprotein Cholesterol Levels in Healthy Subjects." N. Engl. J. Med. 323: 439-445.

Mikkilineni and Rocheford (2003) "Sequence variation and genomic organization of fatty acid desaturase-2 (fad2) and fatty acid desaturase-6 (fad6) cDNAs in maize." Theor. Applied Genetics, 106, 1326-1332.

Millar and Waterhouse (2005) "Plant and animal microRNAs: similarities and differences." Funct Integr Genomics, 2005, 5:129-135.

Miquel et al. (1992) "Arabidopsis mutants deficient in polyunsaturated fatty acid synthesis: Biochemical and genetic characterization of a plant oleoyl-phosphatidylcholine desaturase" Journal of Biological Chemistry; vol. 267 No. 3, 1502-1509.

Moghadasian and Frohlich (1999) "Effects of Dietary Phytosterols on Cholesterol Metabolism and Atherosclerosis: Clinical and Experimental Evidence." Am. J. Med. 107: 588-94.

Mojovic et al., (1993) "Rhizopus arrhizus lipase-catalyzed interesterification of the midfraction of palm oil to a cocoa butter equivalent fat" Enzyme Microb Technol. 15: 438-443.

Morrison (1988) "Lipids in Cereal Starches: A Review." J Cereal Sci. 8:1-15.

Most et al. (2005) "Rice bran oil, not fiber, lowers cholesterol in humans." Am J Clin Nutr 81:64-8.

Mounts et al., (1998) "Effect of Altered Fatty Acid Composition on Soybean Oil Stability" J Am. Oil Chem. Soc. 65: 624-628.

Needleman & Wunsch (1970) "A general method applicable to the search for similarities in the amino acid sequence of two proteins." J. Mol. Biol., 48, 443-453.

Nielsen et al. (2004) Formation of Volatile Compounds in Model Experiments with Crude Leek (*Allium ampeloprasum* Var. *Lancelot*) Enzyme Extract and Linoleic Acid or Linolenic Acid. Journal of Agricultural and Food Chemistry 52:2315-2321.

Noakes and Clifton (1998) "Oil blends containing partially hydrogenated or interesterified fats: differential effects on plasma lipids." Am. J. Clin. Nutr. 98: 242-247.

Nov. 14, 2016 Office Action, issued in connection with Japanese Patent Application No. 2014-549274, including Engligh Language Translation.

O'Brien (2005) "Cottonseed Oil" Bailey's Industrial Oil and Fat Products, 6th Edition, edited by Fereidoon Shahidi.

O'Brien, (2002) Cottonseed Oil. In: F.D. Gunstone (Ed.) Vegetable Oils in Food Technology: Composition, Properties and Uses. Blackwell Publishing, Oxford, pp. 203-230.

Oct. 10, 2016 Response to Second Examination Report, filed in connection with Australian Patent Application No. 2013205482.

Oct. 14, 2015 Application to Amend a Complete Specification, filed in connection with South African Patent Application No. 2014/05075).

Oct. 17, 2016 Third Examination Report, issued in connection with Australian Patent Application No. 2013205482.

Oct. 18, 2013 Amendment, filed in connection with U.S. Appl. No. 13/725,404, filed Dec. 21, 2012.

Oct. 20, 2016 Response to Third Examination Report, filed in connection with Australian Patent Application No. 2013205482.

Ohlrogge and Jaworski (1997) "Regulation of Fatty Acid Synthesis. Annu Rev Plant Physiol Plant Mol Biol." 48:109-136.

Okuley et al. (1994) "*Arabidopsis* FAD2 Gene Encodes the Enzyme that is Essential for Polyunsaturated Lipid Synthesis." Plant Cell, 6:147-158.

PCT International Patent Application International Search Report, dated Dec. 6, 2011 for the related application PCT/AU2001/000794.

Perez-Vich et al. (1998) "Determination of Seed Oil Content and Fatty Acid Composition in Sunflower Through the Analysis of Intact Seeds, Husked Seeds, Meal and Oil by Near-Infrared Reflectance Spectroscopy" JAOCS 75:547-555.

Perriman, R., et al., (1992) "Extended Target-Site Specificity for a Hammerhead Ribozyme," Gene, 113(2): 157-163.

Petrie et al., (2012) "Recruiting a New Substrate for Triacylglycerol Synthesis in Plants: The Monoacylglycerol Acyltransferase Pathway" PLoS One 7(4): e35214, pp. 1-8.

Pirtle et al. (1999) "Characterization of a Palmitoyl-Acyl Carrier Protein Thioesterase (FatB1) in Cotton" Plant Cell Physiology 40:2 p. 155-163.

Pirtle et al., (2001) "Molecular cloning and functional expression of the gene for a cotton v-12 fatty acid desaturase (FAD2)" Biochim. Biophys. Acta 1522: 122-129.

Pokharkar et al., (2008) "Synthesis and Characterization of Fatty Acid Methyl Ester by In-Situ Transesterification in Capparis Deciduas Seed" Leonardo Electronic Journal of Practices and Technologies 13:12-18.

Radcliffe et al. (1997) "Serum Lipids in Rats Fed Diets Containing Rice Bran Oil or High-Linolenic Acid Safflower Oil." Biochemical Archives 13:87-95.

Rajasekharan et al., (2006) "Monoacylglycerol as an intermediate in triacylglycerol biosynthesis in plants" International Symposium on Plant Lipids, Abstract.

Resurreccion et al. (1979) "Nutrient Content and Distribution in Milling Fractions of Rice Grain." Journal of the Science of Food and Agriculture, 30: 475-481.

Roche and Gibney (2000) "Effect of long-chain n-3 polyunsaturated fatty acids on fasting and postprandial triacylglycerol metabolism." Am. J. Clin. Nutr. 71: 232S-237S.

Roston et al., (2012) "TGD1, -2, and -3 Proteins Involved in Lipid Trafficking Form ATP-binding Cassette (ABC) Transporter with Multiple Substrate-binding Proteins" The Journal of Biological Chemistry vol. 287, No. 25, pp. 21406-21415.

Rukmini and Raghuram (1991) "Nutritional and Biochemical Aspects of the Hypolipidemic Action of Rice Bran Oil: A Review." Journal of the American College of Nutrition 10(6):593-601.

Sanjaya et al (2013) "Altered Lipid Composition and Enhanced Nutritional Value of *Arabidopsis* Leaves following Introduction of an Algal Diacylglycerol Acyltransferase 2" Plant Cell, 1-17.

Sanjaya et al. (2011) "Increasing the energy density of vegetative tissues by diverting carbon from starch to oil biosynthesis in transgenic *Arabidopsis*" Plant Biotech. J. 9:874-883.

Sasaki et al., (1999) GenBank Accession No. AP000399, NCBI, pp. 1-33.

Sasaki et al., (2001) GenBank Accession No. AP004047, NCBI, pp. 1-36.

Sasaki et al., (2001) Genbank Accession No. AP004236, NCBI, pp. 1-37.

Sasaki et al., (2002) GenBank Accession No. AP005168, NCBI, pp. 1-31.

(56) References Cited

OTHER PUBLICATIONS

Sasaki et al., (2002) GenBank Accession No. AP005291, NCBI, pp. 1-38.
Sasaki et al., (2002) GenBank Accession No. BAC45170.1, NCBI.
Sasaki et al., (2002) GenBank Accession No. BAC45173.1, NCBI.
Semwal et al. (2011) "Biodiesel production using heterogeneous catalysts" Bioresource Technology 102:2151-2161.
Senior I.J., (1998) "Uses of Plant Gene Silencing." Biotechnology & Genetic Engineering Reviews, Ed. Tombs, M.P., 15:79-119.
Sep. 10, 2018 Office Action issued in connection with Mexican Patent Application No. MX/a/2014/007964.
Sep. 23, 2013 Notice of Allowance, issued in connection with U.S. Appl. No. 13/725,404, filed Dec. 21, 2012.
Sep. 23, 2015 Partial Supplementary European Search Report, issued in connection with European Patent Application No. 12863568.7.
Sharma et al., (2003) GenBank Accesion No. ACI08870, NCBI, pp. 1-27.
Sheikh et al (2002) "Fatty Acids Composition in Germinating Cotton Seedlings Affected by High Temperature Stress" Pakistan Journal of Applied Sciences 2:1 p. 97-99.
Shen, B., et al. (2010). Expression of ZmLEC1 and ZmWRI1 increases seed oil production in maize. Plant physiology, 153(3), 980-987.
Shenstone and Vickery, (1961) "Occurrence of Cyclo-Propene Acids in Some Plants of the Order Malvales" Nature 190: 68-169.
Shiina et al. (1997) "Identification of Promoter Elements Involved in Cytosolic Ca2+-Mediated Photoregulation of Maize cab-m1 Expression" Plant Physiol. 115:477-483.
Shin et al. (1986) "Correlation Between Oxidative Deterioration of Unsaturated Lipid and n-Hexanal during Storage of Brown Rice." J. Food Sci. 51:460-463.
Shippy, R., et al., (1999) "The Hairpin Ribozyme—Discovery, Mechanism, and Development for Gene Therapy," Molecular Biotechnology, 12(1): 117-129.
Singh et al. (2012) "Accumulating Triacylglycerol in leaves via the Monoacylglycerol Acyltransferase Pathway" 20th International Symposium on Plant Lipids.
Sivaraman et al. (2004) "Development of high oleic and low linoleic acid transgenics in a zero erucic acid Brassica juncea L. (Indian mustard) line by antisense suppression of the fad2 gene" Molecular Breeding, Kluwer Academic Publishers, DO; vol. 13 No. 1, 365-375.
Slade and Knauf, (2005) "Tilling moves beyond functional genomics into crop improvement." Transgenic Research, 14:109-115.
Slocombe et al (2009) "Oil accumulation in leaves directed by modification of fatty acid breakdown and lipid synthesis pathways" Plant Biotechnology Journal, 7, 694-703.
Smith et al. (2000) "Total silencing by intron-spliced hairpin RNAs" Nature 407:319-320.
Srinivasan et al. (2007) "Heterologous expression of the Baby Boom AP2/ERF transcription factor enhances the regeneration capacity of tobacco (Nicotiana tabacum L.)" Planta 225:341-51.
St Angelo et al. (1980) "Identification of Lipoxygenase-Linoleate Decomposition Products by Direct Gas Chromatography-Mass Spectrometry." J Lipids 1:45-49.
Stalberg et al., (1993) "Deletion Analysis of a 2S Seed Storage Protein Promoter of Brassica napus in Transgenic Tobacco," Plant Molecular Biology, 23(4): 671-683.
Stoutjesdijk et al. (2002) "hpRNA-mediated targeting of the Arabidopsis FAD2 gene gives highly efficient and stable silencing" Plant Physiology, American Society of Plant Physiologists, Rockville, MD, US; vol. 129, 1723-31.
Stoutjesdijk et al., (2000) "High-oleic acid Australian Brassica napus and B. juncea varieties produced by co-suppression of endogenous Δ12-desaturases." Biochem. Soc. Trans. 28: 938-940.
Suzuki et al. (1999) "Volatile Components in Stored Rice [Oryza sativa (L.)] of Varieties with and without Lipoxygenase-3 in Seeds." J. Agric. Food Chem. 47:1119-1124.

Taira et al. (1986) "Lipid Content and Fatty-Acid Composition of Indica and Japonica Types of Nonglutinous Brown Rice" Journal of Agriculture and Food Chemistry; vol. 34 No. 3, 542-545.
Taira et al. (1988) "Fatty Acid Composition of Indica Sinica Javanica and Japonica Groups of Nonglutinous Brown Rice" Journal of Agricultural and Food Chemistry; vol. 36 No. 1, 45-47.
Taira et al. (1989) "Fatty Acid Composition of Indica-Types and Japonica-Types of Rice Bran and Milled Rice" Journal of the American Oil Chemists' Society; vol. 66 No. 9, 1326-1329.
Takeyama, H., et al., (1997) "Expression of the Eicosapentaenoic Acid Synthesis Gene Cluster From Shewanella sp. in a Transgenic Marine Cyanobacterium, Synechococcus sp.," Microbiology, 143(Pt 8): 2725-2731.
Thelen and Ohlrogge (2002) "Metabolic Engineering of Fatty Acid Biosynthesis in Plants." Metabolic Engineering 4: 12-21.
Theriault et al. (1999). "Tocotrienol: A Review of its Therapeutic Potential." Clin. Biochem. 32: 309-19.
Tholstrup et al. (1994) "Fat high in stearic acid favorably affects blood lipids and factor VII coagulant activity in comparison with fats high in palmitic acid or high in myristic and lauric acids." Am. J. Clin. Nutr. 59: 371-377.
To et al., (2012) "Wrinkled Transcription Factors Orchestrate Tissue-Specific Regulation of Fatty Acid Biosynthesis in Arabidopsis" The Plant Cell, vol. 24: 5007-5023.
Toriyama et al., "Haploid and diploid plant regeneration from protoplasts of anther callus in rice." Theor Appl Genet, 1986, 73:16-19.
Trautwein, E.A., (2001) "n-3 Fatty Acids—Physiological and Technical Aspects for Their Use in Food," European Journal of Lipid Science and Technology, 103(1): 45-55.
Tsugita et al (1983) "Cooking Flavor and Texture of Rice Stored under Different Conditions." Agricultural and Biological Chemistry 47: 543-549.
Tsuzuki et al (2004) "Oxidation Rate of Conjugated Linoleic Acid and Conjugated Linolenic Acid is Slowed by Triacylglycerol Esterification and α-Tocopherol." Lipids 39:475-480.
Valvekens, D., et al., (1988) "Agrobacterium tumefaciens-Mediated Transformation of Arabidopsis thaliana Root Explants by Using Kanamycin Selection," Proceedings of the National Academy of Sciences of the United States of America, 85(15) 5536-5540.
Van de Loo, F. J., Broun, P., Turner, S., & Somerville, C. (1995) "An oleate 12-hydroxylase from Ricinus communis L. is a fatty acyl desaturase homolog." Proc. Natl. Acad. Sci. USA, 92, 6743-6747.
Vanhercke et al (2013) "Metabolic engineering of biomass for high energy density: oilseed-like triacylglycerol yields from plant leaves" Plant Biotechnol. J., doi: 10.1111/pbi.12131 (pp. 1-9).
Vanhercke et al. (2012) "Maximizing lipid accumulation in vegetative plant tissues" 8th International Symposium on Biocatalysis and Agricultural Biotechnology.
Vanhercke et al. (2013) "Synergistic effect of WRI1 and DGAT1 coexpression on triacylglycerol biosynthesis in plants" FEBS Letters 587:364-369.
Voelker et al. (1996) "Genetic engineering of a quantitative trait: metabolic and genetic parameters influencing the accumulation of laurate in rapeseed." Plant J. 9: 229-241.
Wagner et al. (1992) "Coupling of adenovirus to transferrin-polylysine/DNA complexes greatly enhances receptor-mediated gene delivery and expression of transfected genes." Proc. Natl. Acad. Sci. USA, 89, 6099-6103.
Wang et al., (1998) "Improved Vectors for Agrobacterium tumefaciens-Mediated Transformation of Monocot Plants." Acta Hort, 1998, 461:401-407.
Waterhouse, P.M., et al., (1998) "Virus Resistance and Gene Silencing in Plants Can be Induced by Simultaneous Expression of Sense and Antisense RNA," Proceedings of the National Academy of Sciences of the United States of America, 95(23): 13959-13964.
Weselake et al. (2009) "Increasing the flow of carbon into seed oil" Biotechnology Advances 27:866-878.
Whitelaw et al. (1986) "A Rice FATB Insertional Mutant Exhibits Improved Growth and Reduced Photoinhibition at High Temperatures" Proceedings of the 55th Australian Cereal Chemistry Conference, 55th Australian Cereal Chemistry Conference, Jul. 3-7, 2008, Sydney Australia, Jul. 3, 2005, pp. 101-104.

(56) References Cited

OTHER PUBLICATIONS

Whitelaw et al., (2004) "Investigation of lipid synthesis in the rice grain: modification of fatty acids in rice bran oil." In C.K. Black, J.F. Panozzo, and G.J. Rebetzke (Eds.), Cereals 2004: Proceedings of the 54th Australian Cereal Chemistry Conference and 11th Wheat Breeders Assembly, Sep. 21-245, 2004, Canberra ACT, North Melbourne VIC: Cereal Chemistry Division, Royal Australian Chemical Institute, AU (pp. 418-420).
Williams et al. (1999) "Impaired Endothelial Function Following a Meal Rich in Used Cooking Fat." J. Am. Coll. Cardiol. 33:1050-1055.
Wood et al. (2009) "A leaf-based assay using interchangeable design principles to rapidly assemble multistep recombinant pathways" Plant Biotech. J. 7: 914-924.
Xu et al., (2005) "Mutation of the TGD1 Chloroplast Envelope Protein Affects Phosphatidate Metabolism in *Arabidopsis*" The Plant Cell, vol. 17, 3094-3110.
Xu et al., (2008) "Cloning and characterization of an acyl-CoA-dependent diacylglycerol acyltransferase 1 (DGAT1) gene from Tropaeolum majus, and a study of the functional motifs of the DGAT protein using site-directed mutagenesis to modify enzyme activity and oil content" Plant Biotechnology Journal 6, pp. 799-818.
Xu et al., (2008) "Lipid Trafficking between the Endoplasmic Reticulum and the Plastid in *Arabidopsis* Requires the Extraplastidic TGD4 Protein" The Plant Cell, vol. 20: 2190-2204.
Xu et al., (2010) "Lipid Transport Mediated by *Arabidopsis* TGD Proteins is Unidirectional from the Endoplasmic Reticulum to the Plastid" Plant Cell Physiol, 51(6): 1019-1028.
Yang & Ohlrogge (2009) "Turnover of Fatty Acids during Natural Senescence of *Arabidopsis*, Brachypodium, and Switchgrass and in *Arabidopsis* b-Oxidation Mutants" Plant Physiology, 150, 1981-1989.
Yang et al. (2010) "A distinct type of glycerol-3-phosphate acyltransferase with sn-2 preference and phosphatase activity producing 2-monoacylglycerol" PNAS 107:12040-12045.
Yasumatsu et al. (1966) "Studies on Cereals Part V Stale Flavor of Stored Rice." Agric. Biol. Chem. 30:483-486.
Yen et al. (2003) "MGAT2, a Monoacylglycerol Acyltransferase Expressed in the Small Intestine" The Journal of Biological Chemistry 278 (20): 18532-18537.
Yen et al., (2002) "Identification of a gene encoding MGAT1, a monoacylglycerol acyltransferase" PNAS USA 99(13):8512-8517.
Zhou et al. (2002) "Ageing of Stored Rice: Changes in Chemical and Physical Attributes." Journal of Cereal Science 35:65-78.
Zock et al. (1994) "Impact of myristic acid versus palmitic acid on serum lipid and piloprotein levels in healthy women and men." Arterioscler Thromb. 14: 567-575.
Andre, C, et al. (2012). Feedback regulation of plastidic acetyl-CoA carboxylase by 18: 1-acyl carrier protein in *Brassica napus*. Proceedings of the National Academy of Sciences, 109(25), 10107-10112.
Apr. 16, 2013 Chinese Notice of Rejection, issued in connection with Chinese Patent Application No. 200780033971.4, including English Language Translation.
Apr. 16, 2013 Response, filed in connection with Japanese Patent Application No. 2009-519744.
Aug. 1, 2013 Request for Re-Examination, filed in connection with Chinese Patent Application No. 200780033971.4.
Aug. 1, 2013 Response, filed in connection with Chinese Patent Application No. 200780033971.4, including English Language pending claims.
Aug. 21, 2014 Response to Search Report, filed in connection with European Patent Publication No. 11799957.3.
Aug. 21, 2014 Response, filed in connection with Canadian Patent Application No. 2,693,630.
Aug. 27, 2013 Response, filed in connection with European Patent Application No. 07763775.9.

Aug. 28, 2018 Written Opinion issued in connection with Chilean patent application 201700049, including English language translation.
Aug. 30, 2016 Examination Report, issued in connection with Chinese Patent Application No. 201510550052.0, including English Language Translation.
Awai et al (2006). Lipid trafficking between the endoplasmic reticulum and the chloroplast. Biochem. Soc. Trans. 34:395-398.
Bao and Ohlrogge, (1999) Supply of Fatty Acid is One Limiting Factor in the Accumulation of Triacylglycerol in Developing Embryos. Plant Physiology, 1999, 120:1057-1062.
Baud and Lepiniec (2010). Physiological and developmental regulation of seed oil production. Progr. Lipid Res. 49: 235-249.
Benning et al (2009). A 25-amino acid sequence of the *Arabidopsis* TGD2 protein is sufficient for specific binding of phosphatidic acid. J. Biol. Chem 284:17420-17427.
Chen et al (2011). Three homologous genes encoding sn-glycerol-3-phosphate acyltransferase 4 exhibit different expression patterns and functional divergence in *Brassica napus*. Plant Physiol. 155:851-865.
Christie (1993). Preparation of ester derivatives of fatty acids for chromatographic analysis. Advances in Lipid Methodology-Two, Oily Press, Dundee, pp. 195-213.
Amended Claims filed on Oct. 19, 2015 in connection with PCT International Application No. PCT/AU2014/050433, filed Dec. 18, 2014.
Dec. 2, 2014 Fifth Chinese Office Action, issued in connection with Chinese Patent Application No. 200780033971.4, including English Language Translation.
Dec. 21, 2018 Response filed to the Aug. 1, 2018 Examination Report which issued in connection with corresponding European Patent Application No. 15175769.7.
Dec. 28, 2015 Response to Second Office Action, filed in connection with Russian Patent Application No. 2013102419, including English Language Translation.
Dec. 6, 2013 Response, filed in connection with Australian Patent Application No. 2007272316.
Demand for International Preliminary Examination filed on Oct. 19, 2015 in connection with PCT International Application No. PCT/AU2014/050433, filed Dec. 18, 2014.
Dyer J et al., "Molecular Analysis of a Bifunctional Fatty Acid Conjugase/Desaturase from Tung. Implications for the Evolution of Plant Fatty Acid Diversity" Plant Physiol. 130 pp. 2027-2038 (2002).
English Language Translation of Apr. 16, 2013 Grounds of Rejection, issued in connection with Chinese Patent Application No. 200780033971.4.
English language translation of Jan. 6, 2014 First Office Action, issued in connection with Chinese Patent Application No. 201180041568.2.
English Language translation of May 21, 2013 Office Action, issued in connection with Japanese Patent Application No. 2009-519744.
English Language Translation of May 21, 2013 Second Japanese Office Action, issued in connection with Japanese Patent Application No. 2009-519744.
English Translation of Feb. 19, 2016 Office Action, issued in connection with Russian Federation Patent Application No. 2013102419.
English Translation of Jun. 26, 2013 Office Action, issued in connection with Chinese Patent Application No. 200980134226.8.
English Translation of Office Action dated Aug. 27, 2010 in connection with Chinese Patent Application No. 200780033971.4.
European Examination Report dated Apr. 1, 2011 by the European Patent Office in connection with European Patent Application No. 07763775.9.
European Examination Report dated Jun. 8, 2010 by the European Patent Office in connection with European Patent Application No. 07763775.9.
European Patent Office Communication Pursuant to Rules 70(2) and 70a(2) EPC dated Dec. 11, 2015 in connection with European Patent Application No. EP13782495.9, filed Apr. 24, 2013.
Examination Report dated Aug. 1, 2018 which issued in connection with corresponding European patent application 15175769.7.

(56) References Cited

OTHER PUBLICATIONS

Examination Report which dated Jun. 8, 2012 in connection with Australian Patent Application No. 2007272316.
Extended European Search Report dated Nov. 25, 2015 in connection with European Patent Application No. EP13782495.9, filed Apr. 24, 2013.
Extended European Search Report, completed Nov. 19, 2015 in connection with European Patent Application No. 15175769.7, filed Jul. 7, 2015.
Fan J., & Xu, C. (2011). Genetic analysis of *Arabidopsis* mutants impaired in plastid lipid import reveals a role of membrane lipids in chloroplast division. Plant signaling & behavior, 6(3), 458-460.
Fan. J. et al. "Dual Role for Phospholipid: Diacylglycerol Acyltransferase: Enhancing Fatty Acid Synthesis and Diverting Fatty Acids from Membrane Lipids to Triacylglycerol in *Arabidopsis* Leaves", The Plant Cell, 2013, vol. 25, pp. 3506-3518. Whole document.
Feb. 13, 2014 Amendments, filed in connection with South African Patent Application No. 2013/00684.
Feb. 20, 2019 Office Action and its English translation which issued in connection with corresponding Russian Patent Application No. 2017102934.
Feb. 21, 2014 Office Action, issued in connection with Canadian Patent Application No. 2,693,630.
Feb. 23, 2016 Proposed Amendments, filed in connection with European Patent Application No. 07763775.9.
Feb. 29, 2016 Communication Pursuant to Article 94(3) EPC, issued in connection with European Patent Application No. 11799957.3.
Feeney, M. et al. (2013). Following Vegetative to Embryonic Cellular Changes in Leaves of *Arabidopsis thaliana* Over-Expressing Leafy Cotyledon2. Plant physiology, pp. 113.
Fourth Office Action which dated Aug. 3, 2012 in connection with Chinese Patent Application No. 200780033971.4, including English language translation.
Froissard et al. (2009) Heterologous expression of AtClo1, a plant oil body protein, induces lipid accumulation in yeast. FEMS yeast research, 9(3), 428-438.
Hartman, B.E. & Hatcher, P.G. "Hydrothermal liquefaction of isolated cuticle of Agave americana and Capsicum annuum: Chemical characterization of petroleum-like products", Fuel, Apr. 2015, vol. 156, pp. 225-233. Abstract, pp. 225-227.
Horn et al. (2013). Identification of a new class of lipid droplet-associated proteins in plants. Plant physiology, pp. 113.
Ichihara et al (1988). Diacylglycerol acyltransferase in maturing safflower seeds: its influences on the fatty acid composition of triacylglycerol and on the rate of triacylglycerol synthesis. Biochimica et Biophysica Acta (BBA)-Lipids and Lipid Metabolism, 958(1), 125-129.
International Preliminary Report dated Jan. 25, 2011 by International Searching Authority (ISA/US) in connection with International Application No. PCT/AU2006/000930.
International Preliminary Report on Patentability dated Jan. 14, 2009 in connection with PCT International Patent Application No. PCT/AU2007/000977.
International Search Report dated Aug. 13, 2013 in connection with International Patent Application No. PCT/AU2013/000426, filed Apr. 24, 2013.
International Search Report issued by International Searching Authority (ISA.AU) dated Oct. 25, 2007 in connection with International Application No. PCT/AU2007/000977.
International Search Report dated Sep. 8, 2009 by the International Searching Authority (ISA/US) in connection with International Application No. PCT/AU2006/000930.
International Search Report dated Sep. 8, 2009 in Connection with International Application No. PCT/AU2009/000929.
International Search Report, dated Aug. 19, 2015 in connection with PCT International Application No. PCT/AU2015/050380, filed Jul. 7, 2015.
Jan. 12, 2016 Office Action, issued in connection with Japanese Patent Application No. 2013-240977, including English Language Translation.
Jan. 14, 2019 Office Action issued in connection with corresponding Philippine Patent Application No. 1-2016-502588.
Jan. 28, 2014 Extended European Search Report, issued in connection with European Patent Publication No. 11799957.3.
Jan. 28, 2016 Response to the Summons to Oral Proceedings, filed in connection with European Patent Application No. 07763775.9.
Jan. 4, 2016 Response, filed in connection with European Patent Application No. 1179957.3.
Jessen et al (2015). Two Activities of Long-Chain Acyl-Coenzyme A Synthetase Are Involved in Lipid Trafficking between the Endoplasmic Reticulum and the Plastid in *Arabidopsis*. Plant Physiology, 2015, vol. 167, pp. 351-366 (published Dec. 2014).
Jul. 10, 2014 Third Party Observations, filed in connection with European Patent Publication No. 11799957.3.
Jul. 17, 2019 Office Action issued in connection with Russian Patent Application No. 2017102934, including the English Language Translation.
Jul. 17, 2019 Search Report, issued in connection with Russian Patent Application No. 201702934, including the English Language Translation.
Jul. 31, 2013 Declaration, filed in connection with Chinese Patent Application No. 200780033971.4.
Jun. 6, 2019 Office Action issued in connection with Chilean Patent Application No. 201700049, including the English Language Translation.
Kelly, A.A et al. "The Sugar-Dependenti Lipase Limits Triacylglycerol Accumulation in Vegetative Tissues of *Arabidopsis*", Plant Physiology, 2013, vol. 162, pp. 12 82-1289. Abstract, pp. 1283-1286, Figure 6, Materials and Methods.
Knutzon et al. (1995). Cloning of a coconut endosperm cDNA encoding a 1-acyl-sn-glycerol-3-phosphate acyltransferase that accepts medium-chain-length substrates. Plant Physiol. 109:999-1006.
Kruse, A. et al. "Hydrothermal conversion of biomass to fuels and energetic materials", Current Opinion in Chemical Biology, 2013, vol. 17, pp. 515-521. Abstract, pp. 515-517.
Kuhn et al. (2009). The Ostreococcus tauri ADP-glucose pyrophosphorylase reveals alternative paths for the evolution of subunit roles. J. Biol. Chem. 284:34092-34102.
Kunst et al. (1988). Altered regulation of lipid biosynthesis in a mutant of *Arabidopsis* deficient in chloroplast glycerol-3-phosphate acyltransferase activity. Proc. Natl. Acad. Sci. U.S.A. 85:4143-4147.
Lee et al., (2003). *Arabidopsis* Leafy Cotyledon1 represents a functionally specialized subunit of the CCAAT binding transcription factor. Proc. Natl. Acad. Sci. U.S.A. 100:2152-2156.
Letter to the International Preliminary Examination Authority filed on Oct. 19, 2015 in connection with PCT International Application No. PCT/AU2014/050433, filed Dec. 18, 2014.
Li-Beisson et al (2013). Acyl-Lipid Metabolism. The *Arabidopsis* Book, 2013, Published By: The American Society of Plant Biologists.
Liu et al (2012). Hyperoside protects cortical neurons from oxygen-glucose deprivation-reperfusion induced injury via nitric oxide signal pathway. Prog. Lipid Res. 51:350-377.
Lotan et al. (1998). *Arabidopsis* Leafy Cotyledon1 is Sufficient to Induce Embryo Development in Vegetative Cells. Cell 93: 1195-1205.
Lu et al (2007). A Small ATPase Protein of *Arabidopsis*, TGD3, Involved in Chloroplast Lipid Import. J. Biol. Chem. 282: 35945-35953.
Luerssen et al. (1998). FUSCA3 encodes a protein with a conserved VP1/ABI3-like B3 domain which is of functional importance for the regulation of seed maturation in *Arabidopsis thaliana*. Plant J. 15: 755-764.
Mar. 17, 2016 Decision, issued in connection with European Patent Application No. 07763755.9.
Mar. 20, 2015 Response to Jan. 14, 2015 Communication, filed in connection with European Patent Application No. EP 07763775.9.

(56) References Cited

OTHER PUBLICATIONS

May 13, 2019 Response filed to the Jan. 14, 2019 Office Action issued in connection with corresponding Philippine Patent Application No. 1-2016-502588.
May 16, 2013 Response to Japanese Office Action, filed in connection with Japanese Patent Application No. 2009-519744.
May 21, 2013 Response to Office Action, filed in connection with Chinese Patent Application No. 201180041568.2.
Mongrand et al. (1998). The C16: 3\C18: 3 fatty acid balance in photosynthetic tissues from 468 plant species. Phytochemistry 49:1049-1064.
Moreno-Perez (2012). Reduced expression of FatA thioesterases in *Arabidopsis* affects the oil content and fatty acid composition of the seeds. Planta (2012) 235:629-639.
Moreno-Perez et al (2014). Effect of a mutagenized acyl-ACP thioesterase FATA allele from sunflower with improved activity in tobacco leaves and *Arabidopsis* seeds. Planta, 2014, vol. 239, pp. 667-677.
Mu et al. (2008). Leafy Cotyledon1 is a Key Regulator of Fatty Acid Biosynthesis in *Arabidopsis* Plant Physiol. 148:1042-1054.
Naim et al. (2012). Advanced engineering of lipid metabolism in Nicotiana benthamiana using a draft genome and the V2 viral silencing-suppressor protein. PLoS One 7: e52717.
Nov. 15, 2013 Office Action, issued in connection with Australian Patent Application No. 2007272316.
Oct. 9, 2013 European Examination Report, issued in connection with European Patent Application No. 07763775.9.
Ohlrogge and Browse (1995). Lipid biosynthesis. Plant Cell 7: 957-970.
Pasquinelli et al., MicroRNAs: a developing story. Current Opinion in Genetics & Development, 2005, 15:200-205.
Phillips et al. (2002). Free and Esterified Sterol Composition of Edible Oils and Fats. Journal of Food Composition and Analysis 12:123-142.
Response filed to the third Office Action filed on Apr. 5, 2012 in connection with Chinese Patent Application No. 200780033971.4, including English language claims.
Response to European Examination Report, filed with the European Patent Office in Connection dated Dec. 16, 2010 in connection with European Patent Application No. 07763775.9.
Response to European Examination Report, filed with the European Patent Office in Connection dated Oct. 3, 2011 in connection with European Patent Application No. 07763775.9.
Response to First Office Action filed with the Chinese Patent Office dated Jan. 11, 2011 in connection with Chinese Patent Application No. 200780033971.4, and an English Translation of the Claims.
Response to Second Office Action and English Translation of Claims, filed with the Chinese Patent Office dated Aug. 3, 2011 in connection with Chinese Patent Application No. 200780033971.4, and an English Translation of the Claims.
Reynolds, K. B. et al. "Metabolic engineering of medium-chain fatty acid biosynthesis in *Nicotiana benthamiana* plant leaf lipids", Frontiers in Plant Science, Mar. 2015, vol. 6: Article 164 (pp. 1-14). Whole document.
Santos-Mendoza et al. (2005). Leafy Cotyledon 2 activation is sufficient to trigger the accumulation of oil and seed specific mRNAs in *Arabidopsis* leaves. FEBS Lett. 579:4666-4670.
Santos-Mendoza et al. (2008). Deciphering gene regulatory networks that control seed development and maturation in *Arabidopsis*. Plant J. 54:608-620.
Schnurr et al. (2002). Fatty Acid Export from the Chloroplast. Molecular Characterization of a Major Plastidial Acyl-Coenzyme A Synthetase from *Arabidopsis*. Plant Physiol. 129:1700-1709.
Sep. 12, 2014 Second Chinese Office Action, issued in connection with Chinese Patent Application No. 201180041568.2, including English language translation thereof.
Sep. 12, 2016 Response to Feb. 29, 2016 Examination Report, filed in connection with European Patent Application No. 11799957.3.
Sep. 2, 2013 First Examination Report, issued in connection with Australian Patent Application No. 2011274301.
Sep. 2, 2016 First Examination Report issued in connection with Indian patent application 107/MUMNP/2009.
Sep. 25, 2015 Summons to Oral Proceedings, issued in connection with European Patent Application No. EP 07763775.9.
Sep. 9, 2015 Response to Examination Report, filed in connection with Canadian Patent Application No. 2,693,630 First Office Action which dated Oct. 16, 2012 in connection with Japanese Patent Application No. 2009-519744.
Shimada et al. (2014). Leaf Oil Body Functions as a Subcellular Factory for the Production of a Phytoalexin in *Arabidopsis*. Plant Physiol. 164:105-118.
Shockey et al. (2002). *Arabidopsis* Contains Nine Long-Chain Acyl-Coenzyme A Synthetase Genes That Participate in Fatty Acid and Glycerolipid Metabolism. Plant Physiol. 129:1710-1722.
Stone et al. (2001). Leafy Cotyledon2 encodes a B3 domain transcription factor that induces embryo development. Proc. Natl. Acad. Sci. U.S.A. 98: 11806-11811.
Stone et al. (2008). *Arabidopsis* Leafy Cotyledon2 induces maturation traits and auxin activity: Implications for somatic embryogenesis. Proc. Natl. Acad. Sci. U.S.A.105: 3151-3156.
Supplementary European Search Report dated Feb. 23, 2010 in connection with corresponding European Patent Application No. 07763775.9.
Third Office Action which dated Nov. 16, 2011 in connection with Chinese Patent Application No. 200780033971.4, including English language translation.
Timothy Durrett et al., "Plant triacylglycerols as feedstocks for the production of biofuels", The Plant Journal, May 1, 2008, vol. 54, No. 4, pp. 593-607.
Van Erp, H. et al. "Mul tigene Engineering of Triacylglycerol Metabolism Boosts Seed Oil Content in *Arabidopsis*", Plant Physiology, 2014, vol. 165, pp. 30-36. Abstract, pp. 31-33, Materials and Methods.
Vanhercke et al (2013) "Metabolic engineering of biomass for high energy density: oilseed-like triacylglycerol yields from plant leaves" Plant Biotechnol. J., doi: 10.1111/pbi.12131.
Vanhercke, T. et al. "Synergistic effect of WRi1 and DGAT1 coexpression on triacylglycerol biosynthesis in plants", FEBS Letters, 2013, vol. 587, pp. 364-369. Whole document.
Voelker et al. (1992). Fatty Acid Biosynthesis Redirected to Medium Chains in Transgenic Oilseed Plants. Science 257:72-74.
Wang and Benning (2012). TGD4 involved in endoplasmic reticulum-to-chloroplast lipid trafficking is a phosphatidic acid binding protein. Plant J 70:614-623.
Weselake et al. (2008). Metabolic control analysis is helpful for informed genetic manipulation of oilseed rape (*Brassica napus*) to increase seed oil content. J. Exp. Botany 59: 3543-3549.
Winichayakul et al. (2013). In Vivo Packaging of Triacylglycerols Enhances *Arabidopsis* Leaf Biomass and Energy Density. Plant Physiol. 162:626-639.
Written Opinion dated Aug. 18, 2009 by the International Searching Authority (ISA/US) in connection with International Application No. PCT/AU2006/000930.
Written Opinion of the International Search Authority, dated Sep. 8, 2009 in Connection with International Application No. PCT/AU2009/000929.
Written Opinion of the International Searching Authority dated Aug. 13, 2013 in connection with International Patent Application No. PCT/AU2013/000426, filed Apr. 24, 2013.
Written Opinion of the International Searching Authority, dated Aug. 19, 2015 in connection with PCT International Application No. PCT/AU2015/050380, filed Jul. 7, 2015.
Written Opinion, dated Dec. 6, 2011 for the related application PCT/2001/000794.
Wu et al. (1994) "A Mutant Arabidopsis Deficient in the Elongation of Palmitic Acid" Plant Physiol. 106: 143-150.
Wu et al. (1997) "Low-Temperature Damage and Subsequent Mutant *Arabidopsis* Exposed to Recovery of fab1 2OC" Plant Physiol, 113: 347-356.
Mar. 27, 2017 International Search Report issued in connection with PCT International Application No. PCT/AU2017/050012.

(56) References Cited

OTHER PUBLICATIONS

Mar. 27, 2017 Written Opinion of the International Searching Authority issued in connection with PCT International Application No. PCT/AU2017/050012.
Jul. 10, 2018 International Preliminary Report on Patentability issued in connection with PCT International Application No. PCT/AU2017/050012.
Kelly, A. A., et al. (2013). The sugar-dependent1 lipase limits triacylglycerol accumulation in vegetative tissues of *Arabidopsis*. Plant physiology, 162(3), 1282-1289.
Vanhercke, T., et al. (2014). Metabolic engineering of biomass for high energy density: oilseed-like triacylglycerol yields from plant leaves. Plant biotechnology journal, 12(2), 231-239.
Reynolds, K. B., et al. (2015). Metabolic engineering of medium-chain fatty acid biosynthesis in *Nicotiana benthamiana* plant leaf lipids. Frontiers in plant science, 6, 164.
Nookaraju, A., et al. (2014). Enhanced accumulation of fatty acids and triacylglycerols in transgenic tobacco stems for enhanced bioenergy production. Plant cell reports, 33(7), 1041-1052.
Vanhercke, T., et al. (2017). Step changes in leaf oil accumulation via iterative metabolic engineering. Metabolic engineering, 39, 237-246.
Liu, Q., et al. (2017). Genetic enhancement of oil content in potato tuber (*Solanum tuberosum* L.) through an integrated metabolic engineering strategy. Plant biotechnology journal, 15(1), 56-67.
Jun. 23, 2021 Office Action issued in connection with corresponding Argentinian Patent Application No. 20170102448, including English language translation thereof.
El Tahchy, A., et al. (2017). Thioesterase overexpression in *Nicotiana benthamiana* leaf increases the fatty acid flux into triacylglycerol. FEBS letters, 591(2), 448-456.
Yee, S., et al. (2021). Sesamum indicum Oleosin L improves oil packaging in *Nicotiana benthamiana* leaves. Plant direct, 5(9), e343.
May 2, 2022 First Examination Report issued in connection with corresponding Australian patent application 2017204957.
Alvarez, M. L., et al. (2000). Silencing of HMW glutenins in transgenic wheat expressing extra HMW subunits. Theoretical and Applied Genetics, 100(2), 319-327.
Bartlett, J. G., et al. (2008). High-throughput Agrobacterium-mediated barley transformation. Plant Methods, 4(1), 22.
Bates, P. D. (2016). Understanding the control of acyl flux through the lipid metabolic network of plant oil biosynthesis. Biochimica et Biophysica Acta (BBA)—Molecular and Cell Biology of Lipids, 1861(9), 1214-1225.
Baud, S., et al. (2007). Wrinkled1 specifies the regulatory action of Leafy Cotyledon2 towards fatty acid metabolism during seed maturation in Arabidopsis. The Plant Journal, 50(5), 825-838.
Bäumlein, H., et al. (1992). Cis-analysis of a seed protein gene promoter: the conservative RY repeat CATGCATG within the legumin box is essential for tissue-specific expression of a legumin gene. The Plant Journal, 2(2), 233-239.
Belide, S., et al. (2013). Rapid expression and validation of seed-specific constructs in transgenic LEC2 induced somatic embryos of Brassica napus. Plant Cell, Tissue and Organ Culture (PCTOC), 113(3), 543-553.
Bibikova, M., et al. (2002). Targeted chromosomal cleavage and mutagenesis in *Drosophila* using zinc-finger nucleases. Genetics, 161(3), 1169-1175.
Bihmidine, S., et al. (2015). Sucrose accumulation in sweet sorghum stems occurs by apoplasmic phloem unloading and does not involve differential sucrose transporter expression. BMC plant biology, 15(1), 186.
Bihmidine, S., et al. (2016). Tonoplast Sugar Transporters (SbTSTs) putatively control sucrose accumulation in sweet sorghum stems. Plant signaling & behavior, 11(1), e1117721.
Bourque, J. E. (1995). Antisense strategies for genetic manipulations in plants. Plant Science, 105(2), 125-149.
Boutilier, K., et al. (2002). Ectopic expression of Baby Boom triggers a conversion from vegetative to embryonic growth. The Plant Cell, 14(8), 1737-1749.
Bradford, M. M. (1976). A rapid and sensitive method for the quantitation of microgram quantities of protein utilizing the principle of protein-dye binding. Analytical biochemistry, 72(1-2), 248-254.
Braun, D. M., & Slewinski, T. L. (2009). Genetic control of carbon partitioning in grasses: roles of sucrose transporters and tie-dyed loci in phloem loading. Plant Physiology, 149(1), 71-81.
Broothaerts, W., et al. (2005). Gene transfer to plants by diverse species of bacteria. Nature, 433(7026), 629-633.
Browse, J., et al. (1986). Fluxes through the prokaryotic and eukaryotic pathways of lipid synthesis in the '16: 3'plant *Arabidopsis thaliana*. Biochemical Journal, 235(1), 25-31.
Buchanan-Wollaston, V. (1994). Isolation of cDNA clones for genes that are expressed during leaf senescence in *Brassica napus* (identification of a gene encoding a senescence-specific metallothionein-like protein). Plant Physiology, 105(3), 839-846.
Busk, P. K., et al. (1997). Regulatory elements in vivo in the promoter of the abscisic acid responsive gene rab17 from maize. The Plant Journal, 11(6), 1285-1295.
Capuano, F., et al. (2007). Properties and exploitation of oleosins. Biotechnology advances, 25(2), 203-206.
Chikwamba, R. K., et al. (2003). Localization of a bacterial protein in starch granules of transgenic maize kernels. Proceedings of the National Academy of Sciences, 100(19), 11127-11132.
Chung, B. Y., et al. (2006). Effect of 5'UTR introns on gene expression in *Arabidopsis thaliana*. BMC genomics, 7(1), 120.
Cong, L., et al. (2013). Multiplex genome engineering using CRISPR/Cas systems. Science, 339(6121), 819-823.
Coutu, C., et al. (2007). pORE: a modular binary vector series suited for both monocot and dicot plant transformation. Transgenic research, 16(6), 771-781.
Dahlqvist, A., et al. (2000). Phospholipid: diacylglycerol acyltransferase: an enzyme that catalyzes the acyl-CoA-independent formation of triacylglycerol in yeast and plants. Proceedings of the National Academy of Sciences, 97(12), 6487-6492.
Damaj, M. B., et al. (2010). Sugarcane DIRIGENT and O-methyltransferase promoters confer stem-regulated gene expression in diverse monocots. Planta, 231(6), 1439-1458.
Dauk, M., et al. (2007). A FAD2 homologue from *Lesquerella lindheimeri* has predominantly fatty acid hydroxylase activity. Plant science, 173(1), 43-49.
Ellerström, M., et al. (1996). Functional dissection of a napin gene promoter: identification of promoter elements required for embryo and endosperm-specific transcription. Plant molecular biology, 32(6), 1019-1027.
Fan, J., et al. (2013). Phospholipid: diacylglycerol acyltransferase-mediated triacylglycerol biosynthesis is crucial for protection against fatty acid-induced cell death in growing tissues of Arabidopsis. The Plant Journal, 76(6), 930-942.
Fan, J., et al. (2014). Arabidopsis lipins, PDAT1 acyltransferase, and SDP1 triacylglycerol lipase synergistically direct fatty acids toward β-oxidation, thereby maintaining membrane lipid homeostasis. The Plant Cell, 26(10), 4119-4134.
Fan, J., et al. (2015). *Arabidopsis* Trigalactosyldiacylglycerol5 interacts with TGD1, TGD2, and TGD4 to facilitate lipid transfer from the endoplasmic reticulum to plastids. The Plant Cell, 27(10), 2941-2955.
Protein Sources for the Animal Feed Industry. Proceedings of the Food And Agriculture Organization of the United Nations Protein Sources, Expert Consultation and Workshop Bangkok, Apr. 29, 2002-May 3, 2002.
Finkelstein, R. R., et al. (1998). The *Arabidopsis* abscisic acid response locus ABI4 encodes an APETALA2 domain protein. The Plant Cell, 10(6), 1043-1054.
Gazzarrini, S., et al. (2004). The transcription factor FUSCA3 controls developmental timing in *Arabidopsis* through the hormones gibberellin and abscisic acid. Developmental cell, 7(3), 373-385.

(56) References Cited

OTHER PUBLICATIONS

Ghosh, A. K., et al. (2009). At4g24160, a soluble acyl-coenzyme A-dependent lysophosphatidic acid acyltransferase. Plant physiology, 151(2), 869-881.

Gidda, S. K., et al. (2013). Lipid droplet-associated proteins (LDAPs) are involved in the compartmentalization of lipophilic compounds in plant cells. Plant signaling & behavior, 8(11), e27141.

Girijashankar, V., & Swathisree, V. (2009). Genetic transformation of Sorghum bicolor. Physiology and molecular biology of plants, 15(4), 287-302.

Gould, J., et al. (1991). Transformation of *Zea mays* L. using *Agrobacterium tumefaciens* and the shoot apex. Plant physiology, 95(2), 426-434.

Guan, H. P., et al. (2015). Glucagon receptor antagonism induces increased cholesterol absorption. Journal of lipid research, 56(11), 2183-2195.

Gurel, S., et al. (2009). Efficient, reproducible Agrobacterium-mediated transformation of sorghum using heat treatment of immature embryos. Plant cell reports, 28(3), 429-444.

Gutiérrez, S. P., et al. (2013). Protein body formation in stable transgenic tobacco expressing elastin-like polypeptide and hydrophobin fusion proteins. BMC biotechnology, 13(1), 40.

Hinchee, M. A., et al. (1988). Production of transgenic soybean plants using Agrobacterium-mediated DNA transfer. Bio/technology, 6(8), 915-922.

Horvath, H., et al. (2000). The production of recombinant proteins in transgenic barley grains. Proceedings of the National Academy of Sciences, 97(4), 1914-1919.

Huang, A. H. (1996). Oleosins and oil bodies in seeds and other organs. Plant physiology, 110(4), 1055.

Huang, M. D., & Huang, A. H. (2016). Subcellular lipid droplets in vanilla leaf epidermis and avocado mesocarp are coated with oleosins of distinct phylogenic lineages. Plant physiology, 171(3), 1867-1878.

Ikeda, M., et al. (2006). Embryogenesis-related genes; its expression and roles during somatic and zygotic embryogenesis in carrot and *Arabidopsis*. Plant Biotechnology, 23(2), 153-161.

Iwabuchi, M., et al. (2003). Δ12-oleate desaturase-related enzymes associated with formation of conjugated trans-Δ11, cis-Δ13 double bonds. Journal of Biological Chemistry, 278(7), 4603-4610.

Jiang, W., et al. (2013). Demonstration of CRISPR/Cas9/sgRNA-mediated targeted gene modification in *Arabidopsis*, tobacco, sorghum and rice. Nucleic acids research, 41(20), e188-e188.

Kereszt, A., et al. (2007). Agrobacterium rhizogenes-mediated transformation of soybean to study root biology. Nature protocols, 2(4), 948.

Kim, Y. G., et al. (1996). Hybrid restriction enzymes: zinc finger fusions to Fok I cleavage domain. Proceedings of the National Academy of Sciences, 93(3), 1156-1160.

Kim, M. J., et al. (2016). The mediator complex MED15 subunit mediates activation of downstream lipid-related genes by the Wrinkled1 transcription factor. Plant physiology, 171(3), 1951-1964.

Klemens, P. A., et al. (2013). Overexpression of the vacuolar sugar carrier AtSweet16 modifies germination, growth, and stress tolerance in Arabidopsis. Plant Physiology, 163(3), 1338-1352.

Kwong, R. W., et al. (2003). Leafy Cotyledon1-Like defines a class of regulators essential for embryo development. The Plant Cell, 15(1), 5-18.

Lacroix, B., et al. (2008). Association of the Agrobacterium T-DNA-protein complex with plant nucleosomes. Proceedings of the National Academy of Sciences, 105(40), 15429-15434.

Laemmli, U. K. (1970). Cleavage of structural proteins during the assembly of the head of bacteriophage T4. nature, 227(5259), 680-685.

Laibach, N., et al. (2018). Small rubber particle proteins from *Taraxacum brevicorniculatum* promote stress tolerance and influence the size and distribution of lipid droplets and artificial poly (cis-1, 4-isoprene) bodies. The Plant Journal, 93(6), 1045-1061.

Larkin, P. J., et al. (1996). Transgenic white clover. Studies with the auxin-responsive promoter, GH3, in root gravitropism and lateral root development. Transgenic research, 5(5), 325-335.

Laux, T., et al. (1996). The Wuschel gene is required for shoot and floral meristem integrity in *Arabidopsis*. Development, 122(1), 87-96.

Li, S. F., et al. (1996). A novel myb-related gene from *Arabidopsis thaliana*. FEBS letters, 379(2), 117-121.

Li, Y., et al. (2006). Oil content of *Arabidopsis* seeds: the influence of seed anatomy, light and plant-to-plant variation. Phytochemistry, 67(9), 904-915.

Li, J., et al. (2016). Development of a Simple and Efficient Method for Agrobacterium-Mediated Transformation in Sorghum. International Journal of Agriculture & Biology, 18(1).

Linder, M. B., Szilvay, G. R., Nakari-Setala, T., & Penttilä, M. E. (2005). Hydrophobins: the protein-amphiphiles of filamentous fungi. FEMS microbiology reviews, 29(5), 877-896.

Liu, G., & Godwin, I. D. (2012). Highly efficient sorghum transformation. Plant cell reports, 31(6), 999-1007.

Liu, Y. F., et al. (2014). Soybean GmMYB73 promotes lipid accumulation in transgenic plants. BMC plant biology, 14(1), 73.

Liu, G., et al. (2015). A robust tissue culture system for sorghum [Sorghum bicolor (L.) Moench]. South African Journal of Botany, 98, 157-160.

Lu, B., et al. (2007). A small ATPase protein of *Arabidopsis*, TGD3, involved in chloroplast lipid import. Journal of Biological Chemistry, 282(49), 35945-35953.

Ma, W., et al. (2016). 14-3-3 protein mediates plant seed oil biosynthesis through interaction with AtWRI1. The Plant Journal, 88(2), 228-235.

Maceachran, D. P., et al. (2010). The *Rhodococcus opacus* PD630 heparin-binding hemagglutinin homolog TadA mediates lipid body formation. Appl. Environ. Microbiol., 76(21), 7217-7225.

Matsuoka, M., & Minami, E. I. (1989). Complete structure of the gene for phosphoenolpyruvate carboxylase from maize. European journal of biochemistry, 181(3), 593-598.

Matsuoka, M., et al. (1994). The promoters of two carboxylases in a C4 plant (maize) direct cell-specific, light-regulated expression in a C3 plant (rice). The Plant Journal, 6(3), 311-319.

McCleary, B. V., et al. (2010). Determination of total dietary fiber (Codex definition) by enzymatic-gravimetric method and liquid chromatography: Collaborative study. Journal of AOAC international, 93(1), 221-233.

McCleary, B. V., et al. (2015). Determination of total dietary fibre and available carbohydrates: A rapid integrated procedure that simulates in vivo digestion. Starch-Stärke, 67(9-10), 860-883.

McElroy, D., et al. (1990). Isolation of an efficient actin promoter for use in rice transformation. The plant cell, 2(2), 163-171.

McKinley, B., et al. (2016). Dynamics of biomass partitioning, stem gene expression, cell wall biosynthesis, and sucrose accumulation during development of Sorghum bicolor. The Plant Journal, 88(4), 662-680.

Meier, I., et al. (1997). The tomato RBCS3A promoter requires integration into the chromatin for correct organ-specific regulation. FEBS letters, 415(1), 91-95.

Mizuno, H., et al. (2016). The sorghum Sweet gene family: stem sucrose accumulation as revealed through transcriptome profiling. Biotechnology for biofuels, 9(1), 127.

Mojica, F. J., et al. (2000). Biological significance of a family of regularly spaced repeats in the genomes of Archaea, Bacteria and mitochondria. Molecular microbiology, 36(1), 244-246.

Mudge, S. R., et al. (2013). Mature-stem expression of a silencing-resistant sucrose isomerase gene drives isomaltulose accumulation to high levels in sugarcane. Plant biotechnology journal, 11(4), 502-509.

Murashige, T., & Skoog, F. (1962). A revised medium for rapid growth and bio assays with tobacco tissue cultures. Physiologia plantarum, 15(3), 473-497.

Murphy, D. J. (2012). The dynamic roles of intracellular lipid droplets: from archaea to mammals. Protoplasma, 249(3), 541-585.

(56) References Cited

OTHER PUBLICATIONS

Nishida, I., Tasaka, Y., Shiraishi, H., & Murata, N. (1993). The gene and the RNA for the precursor to the plastid-located glycerol-3-phosphate acyltransferase of *Arabidopsis thaliana*. Plant molecular biology, 21(2), 267-277.
Padidam, M. (2003). Chemically regulated gene expression in plants. Current opinion in plant biology, 6(2), 169-177.
Padidam, M., et al. (2003). Chemical-inducible, ecdysone receptor-based gene expression system for plants. Transgenic research, 12(1), 101-109.
Parthibane, V., et al. (2012). Oleosin is bifunctional enzyme that has both monoacylglycerol acyltransferase and phospholipase activities. Journal of Biological Chemistry, 287(3), 1946-1954.
Parthibane, V., et al. (2012). Serine/threonine/tyrosine protein kinase phosphorylates oleosin, a regulator of lipid metabolic functions. Plant physiology, 159(1), 95-104.
Perrin, Y., et al. (2000). Transgenic pea seeds as bioreactors for the production of a single-chain Fv fragment (scFV) antibody used in cancer diagnosis and therapy. Molecular Breeding, 6(4), 345-352.
Potenza, C., et al. (2004). Targeting transgene expression in research, agricultural, and environmental applications: promoters used in plant transformation. In Vitro Cellular & Developmental Biology-Plant, 40(1), 1-22.
Qiu, X., et al. (2001). Identification of a Δ4 Fatty Acid Desaturase from *Thraustochytrium* sp. Involved in the Biosynthesis of Docosahexanoic Acid by Heterologous Expression in *Saccharomyces cerevisiae* and *Brassica juncea*. Journal of Biological Chemistry, 276(34), 31561-31566.
Robson, P. R., et al. (2004). Leaf senescence is delayed in maize expressing the Agrobacterium IPT gene under the control of a novel maize senescence-enhanced promoter. Plant Biotechnology Journal, 2(2), 101-112.
Ruuska, S. A., et al. (2002). Contrapuntal networks of gene expression during *Arabidopsis* seed filling. The Plant Cell, 14(6), 1191-1206.
Saad, R. B., et al. (2011). Promoter of the AlSAP gene from the halophyte grass *Aeluropus littoralis* directs developmental-regulated, stress-inducible, and organ-specific gene expression in transgenic tobacco. Transgenic research, 20(5), 1003-1018.
Saha, S., et al. (2006). Cytosolic triacylglycerol biosynthetic pathway in oilseeds. Molecular cloning and expression of peanut cytosolic diacylglycerol acyltransferase. Plant Physiology, 141(4), 1533-1543.
Scott, R. W., et al. (2010). Elevation of oil body integrity and emulsion stability by polyoleosins, multiple oleosin units joined in tandem head-to-tail fusions. Plant biotechnology journal, 8(8), 912-927.
Shimada, T. L., & Hara-Nishimura, I. (2010). Oil-body-membrane proteins and their physiological functions in plants. Biological and Pharmaceutical Bulletin, 33(3), 360-363.
Stalker, D. M., et al. (1988). Purification and properties of a nitrilase specific for the herbicide bromoxynil and corresponding nucleotide sequence analysis of the bxn gene. Journal of Biological Chemistry, 263(13), 6310-6314.
Tai, S. S., et al. (2002). Gene family of oleosin isoforms and their structural stabilization in sesame seed oil bodies. Bioscience, biotechnology, and biochemistry, 66(10), 2146-2153.
Tan, H., et al. (2011). Enhanced Seed Oil Production in Canola by Conditional Expression of *Brassica napus* Leafy Cotyledon1 (BnLEC1) and LEC1-LIKE (BnL1L) in Developing Seeds 1.
Taylor, C. B. (1997). Comprehending cosuppression. The Plant Cell, 9(8), 1245.
Thillet, J., et al. (1988). Site-directed mutagenesis of mouse dihydrofolate reductase. Mutants with increased resistance to methotrexate and trimethoprim. Journal of Biological Chemistry, 263(25), 12500-12508.
Tingay, S., et al. (1997). Agrobacterium tumefaciens-mediated barley transformation. The Plant Journal, 11(6), 1369-1376.
Ulmasov, T., et al. (1995). The soybean GH2/4 gene that encodes a glutathione S-transferase has a promoter that is activated by a wide range of chemical agents. Plant physiology, 108(3), 919-927.
Vieler, A., et al. (2012). A lipid droplet protein of Nannochloropsis with functions partially analogous to plant oleosins. Plant physiology, 158(4), 1562-1569.
Voinnet, O., et al. (2003). Retracted: An enhanced transient expression system in plants based on suppression of gene silencing by the p19 protein of tomato bushy stunt virus. The Plant Journal, 33(5), 949-956.
Wang, H., et al. (2002). A chromatin immunoprecipitation (ChIP) approach to isolate genes regulated by AGL15, a MADS domain protein that preferentially accumulates in embryos. The Plant Journal, 32(5), 831-843.
Wormit, A., et al. (2006). Molecular identification and physiological characterization of a novel monosaccharide transporter from *Arabidopsis* involved in vacuolar sugar transport. The Plant Cell, 18(12), 3476-3490.
Wu, E., et al. (2014). Optimized Agrobacterium-mediated sorghum transformation protocol and molecular data of transgenic sorghum plants. In Vitro Cellular & Developmental Biology-Plant, 50(1), 9-18.
Xie, K., et al. (2014). Genome-wide prediction of highly specific guide RNA spacers for CRISPR-Cas9-mediated genome editing in model plants and major crops. Molecular plant, 7(5), 923-926.
Yamagishi, K., et al. (2005). TANMEI/EMB2757 encodes a WD repeat protein required for embryo development in *Arabidopsis*. Plant physiology, 139(1), 163-173.
Yamasaki, K., et al. (2004). Solution structure of the B3 DNA binding domain of the *Arabidopsis* cold-responsive transcription factor RAV1. The Plant Cell, 16(12), 3448-3459.
Yang, D., et al. (2003). Expression and localization of human lysozyme in the endosperm of transgenic rice. Planta, 216(4), 597-603.
Yen, C. L. E., et al. (2005). The triacylglycerol synthesis enzyme DGAT1 also catalyzes the synthesis of diacylglycerols, waxes, and retinyl esters. Journal of lipid research, 46(7), 1502-1511.
Yokoyama, R., et al. (1994). The rolC promoter of *Agrobacterium rhizogenes* Ri plasmid is activated by sucrose in transgenic tobacco plants. Molecular and General Genetics MGG, 244(1), 15-22.
Zale, J., et al. (2016). Metabolic engineering of sugarcane to accumulate energy-dense triacylglycerols in vegetative biomass. Plant biotechnology journal, 14(2), 661-669.
Zheng, Y., et al. (2009). Global identification of targets of the *Arabidopsis* MADS domain protein AGAMOUS-Like15. The Plant Cell, 21(9), 2563-2577.
Zolman, B. K., et al. (2001). The *Arabidopsis* pxa1 mutant is defective in an ATP-binding cassette transporter-like protein required for peroxisomal fatty acid β-oxidation. Plant Physiology, 127(3), 1266-1278.

\* cited by examiner

A

B

PLANTS WITH MODIFIED TRAITS

CROSS-REFERENCE TO RELATED APPLICATIONS

This application is a § 371 national stage of PCT International Application No. PCT/AU2017/050948, filed Sep. 1, 2017, claiming priority of Australian Patent Application No. AU2017902756, filed Jul. 13, 2017, claiming priority of PCT/AU2017/050012, filed Jan. 6, 2017, claiming priority of Australian Patent Nos. AU2016904611, filed Nov. 11, 2016, AU2016903577, filed Sep. 6, 2016, and AU2016903541, filed Sep. 2, 2016 the contents of each of which are hereby incorporated by reference into the application.

REFERENCE TO A SEQUENCE LISTING

This application incorporates-by-reference nucleotide and/or amino acid sequences which are present in the file named "190301_5938_90879_Sequence_Listing_SC.txt", which is 885 kilobytes in size, and which was created Mar. 1, 2019 in the IBM-PC machine format, having an operating system compatibility with MS-Windows, which is contained in the text file filed Mar. 1, 2019 as part of this application.

FIELD OF THE INVENTION

The present invention relates, inter alia, to vegetative plant parts, such as from a *Sorghum* sp. and/or a *Zea mays* plant, which comprise a total fatty acid (TFA) content which comprises fatty acids esterified in the form of triacylglycerols (TAG) and fatty acids in the form of lipids other than TAG, wherein the vegetative plant parts comprise greatly increased levels of TFA, for example a TFA content of about 5% (w/w dry weight). The present invention also relates to the use of the vegetative plant parts as a feedstuff, and/or to produce a feedstuff, for animal consumption.

BACKGROUND OF THE INVENTION

Meeting consumer demands for livestock products, for example meat, milk and eggs is reliant on the availability of regular supplies of safe, cost-effective animal feeds, in particular feeds with high energy such as high levels of fatty acids. As consumer demands for such livestock products increase, particularly in the developing world, for example, global demand for meat products is anticipated to increase 58% between 1995 and 2020 (FAO Animal Production and Health Proceedings, 2002), an increase in feed protein supply is required.

There is a need for vegetative plant parts, particularly vegetative plant parts from important animal feed crops such as *sorghum* and corn, with a high total fatty acid content.

SUMMARY OF THE INVENTION

The present invention relates to plants and vegetative plant parts, preferably from *Sorghum* sp. and/or *Zea mays*, with an enhanced total fatty acid content and their uses.

Thus, in a first aspect, the present invention provides a process for producing a feedstuff for an animal, the process comprising the steps of
(i) harvesting vegetative plant parts from a *Sorghum* sp. and/or a *Zea mays* plant, the vegetative plant parts comprising a total fatty acid (TFA) content which comprises fatty acids esterified in the form of triacylglycerols (TAG) and fatty acids in the form of lipids other than TAG, wherein the vegetative plant parts comprise a TFA content of about 5% (w/w dry weight), and one or more of the steps
(ii) admixing the harvested plant parts with at least one other feed ingredient,
(iii) baling the harvested plant parts,
(iv) processing the harvested plant parts, preferably by chopping, cutting, drying, pressing or pelleting the plant parts, into a form that is suitable for consumption by the animal, and
(v) storing the harvested plant parts under conditions of reduced oxygen for a period of time such that at least some of the carbohydrates in the plant parts are fermented to organic acids.

In an embodiment, the vegetative plant parts have a TAG/TFA Quotient (TTQ) of between 0.01 and 0.6. In an embodiment, the vegetative plant parts have a TTQ of between 0.01 and 0.55, or between 0.01 and 0.5, or about 0.1, or about 0.2 or about 0.3, or about 0.4 or about 0.5. Preferably, the TTQ is between 0.60 and 0.84, which corresponds to a TAG:TFA ratio of between 1.5:1 and 5:1, or between 0.84 and 0.95 which corresponds to a TAG:TFA ratio of between 5:1 and 20:1.

In an embodiment, the vegetative plant parts comprise an average TFA content of about 6%, or about 8%, or about 9% or about 10% (w/w dry weight).

In an embodiment, the TFA content of the vegetative plant parts comprises an oleic acid content which is increased by at least 2% or at least 3% relative to the oleic acid content of a corresponding wild-type vegetative plant part.

In an embodiment, the TFA content of the vegetative plant parts comprises a palmitic acid content which is increased by at least 2% or at least 3% relative to the palmitic acid content of a corresponding wild-type vegetative plant part.

In an embodiment, the TFA content of the vegetative plant parts comprises a α-linoleic acid (ALA) content which is decreased by at least 2% or at least 3% relative to the ALA content of a corresponding wild-type vegetative plant part.

In an embodiment, one or more or all of the following features apply:
(i) the vegetative plant parts are leaves and/or stems or parts thereof which comprise one or more of an increased carbon content, an increased energy content, an increased soluble protein content, a reduced starch content, a reduced total dietary fibre (TDF) content and an increased nitrogen content, each on a weight basis relative to a corresponding wild-type leaf or stem or parts thereof from a wild-type *Sorghum* sp. or *Zea mays* plant at the same stage of growth,
(ii) the TFA content of the vegetative plant parts is at least about 6%, at least about 7%, at least about 8%, at least about 9%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight) TFA,
(iii) the fatty acids esterified in the form of TAG in the vegetative plant parts is at least about 1%, at least about 2%, at least about 3%, at least about 4%, at least about 5%, at least about 6%, at least about 7%, at least about 8%, at least about 9%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), (iv) the vegetative plant parts comprise an increased content of a WRI1 polypeptide, an increased content of a DGAT polypeptide, and a decreased content of a SDP1 polypeptide, each relative to a corresponding wild-type vegetative plant part, (v) the vegetative plant parts comprise an increased content of a WRI1 polypeptide, an increased content of a DGAT polypeptide, and an increased content of a LEC2 polypeptide, each relative to a corresponding wild-type vegetative plant part, (vi) the vegetative plant parts comprise an increased content of a PDAT or DGAT polypeptide, a decreased content of a TGD polypeptide, and a decreased content of a SDP1 polypeptide, each relative to a corresponding wild-type vegetative plant part, and (vii) the vegetative plant parts comprise a decreased content of a TAG lipase such as a SDP1 TAG lipase, a decreased content of a TGD polypeptide such as a TGD5 polypeptide, and optionally a decreased content of a TST polypeptide such as a TST1 polypeptide, each decrease being relative to a corresponding wild-type vegetative plant part.

In second aspect, the present invention provides a process for producing a feedstuff for an animal, the process comprising the steps of (i) harvesting vegetative plant parts from a *Sorghum* sp. and/or a *Zea mays* plant, the vegetative plant parts comprising a total fatty acid content which comprises fatty acids esterified in the form of triacylglycerols (TAG) and fatty acids in the form of lipids other than TAG, wherein the vegetative plant parts comprise a total TAG content of about 6% (w/w dry weight) and preferably have a ratio of the fatty acids esterified in the form of TAG to the fatty acids in the form of lipids other than TAG which is between 20:1 and 1.5:1 or between 5:1 and 2:1, and one or more of the steps (ii) admixing the harvested plant parts with at least one other feed ingredient, (iii) baling the harvested plant parts, (iv) processing the harvested plant parts, preferably by chopping, cutting, drying, pressing or pelleting the plant parts, into a form that is suitable for consumption by the animal, and (v) storing the harvested plant parts under conditions of reduced oxygen for a period of time such that at least some of the carbohydrates in the plant parts are fermented to organic acids.

In an embodiment of the two above aspects, one or more or all of the following features apply:

(i) the vegetative plant parts are harvested from the plant between the time of first flowering of the plant and first maturity of seed, (ii) the *Sorghum* sp. plant is a *Sorghum bicolor* plant, (iii) the vegetative plant parts include leaves and/or stems or parts thereof, (iv) the vegetative plant parts comprise an average total fatty acid content of about 8% or about 10% (w/w dry weight), (v) the total fatty acid content of the vegetative plant parts comprises an oleic acid content which is increased by at least 2% or at least 3% relative to the oleic acid content of a corresponding wild-type vegetative plant part, (vi) the total fatty acid content of the vegetative plant parts comprises a palmitic acid content which is increased by at least 2% or at least 3% relative to the palmitic acid content of a corresponding wild-type vegetative plant part, (vii) the total fatty acid content of the vegetative plant parts comprises a α-linoleic acid (ALA) content which is decreased by at least 2% or at least 3% relative to the ALA content of a corresponding wild-type vegetative plant part, (viii) the vegetative plant parts comprise an increased soluble protein content relative to a corresponding wild-type vegetative plant part, (ix) the vegetative plant parts comprise an increased nitrogen content relative to a corresponding wild-type vegetative plant part, (x) the vegetative plant parts comprise a decreased carbon:nitrogen ratio relative to a corresponding wild-type vegetative plant part, (xi) leaves of the *Sorghum* sp. and/or *Zea mays* plant comprises an increased photosynthetic capacity relative to a corresponding wild-type leaf, (xii) the vegetative plant parts comprise a decreased total dietary fibre (TDF) content relative to a corresponding wild-type vegetative plant part, (xiii) the vegetative plant parts comprise an increased carbon content relative to a corresponding wild-type vegetative plant part, (xiv) the vegetative plant parts comprise an increased transcription factor polypeptide content relative to a corresponding wild-type vegetative plant part, wherein the transcription factor polypeptide is selected from the group consisting of Wrinkled 1 (WRI1), Leafy Cotyledon 1 (LEC1), LEC1-like, Leafy Cotyledon 2 (LEC2), BABY BOOM (BBM), FUS3, ABI3, ABI4, ABI5, Dof4 and Dof11, or the group consisting of MYB73, bZIP53, AGL15, MYB115, MYB118, TANMEI, WUS, GFR2a1, GFR2a2 and PHR1, (xv) the vegetative plant parts comprise an increased fatty acid acyltransferase polypeptide content relative to a corresponding wild-type vegetative plant part, wherein the acyltransferase is diacylglycerol acyltransferase (DGAT) and/or phospholipid: diacylglycerol acyltransferase (PDAT), (xvi) the vegetative plant parts comprise a decreased TAG lipase polypeptide content relative to a corresponding wild-type vegetative plant part, (xvii) the vegetative plant parts comprise a decreased trigalactosyldiacylglycerol (TGD) polypeptide content relative to a corresponding wild-type vegetative plant part, (xviii) the vegetative plant parts comprise an increased content of an oil body coating (OBC) polypeptide or a lipid droplet associated polypeptide (LDAP) relative to a corresponding wild-type vegetative plant part, (xix) the vegetative plant parts comprise an increased total protein content relative to a corresponding wild-type vegetative plant part, (xx) the vegetative plant parts comprise an increased chlorophyll content relative to a corresponding wild-type vegetative plant part, (xxi) the vegetative plant parts comprise an increased energy content on a weight basis relative to a corresponding wild-type vegetative plant part, (xxii) the vegetative plant parts comprise an increased phospholipid and/or galactolipid content, preferably an increased monogalactosyl-diglyceride (MDGD) and/or increased digalactosyl-diglyceride (DGDG) content, relative to a corresponding wild-type vegetative plant part, (xxiii) the ratio of the fatty acids esterified in the form of TAG to the fatty acids in the form of lipids other than TAG is about 4, about 3.5, about 3, or about 2.5, (xxiv) the at least one other feed ingredient comprises one or more or all of: edible macronutrients, vitamins, minerals (such as calcium, phosphorus, magnesium and sulfur), hay such as alfalfa hay, brewers grain, seed meal (canola or soy), cottonseed, molasses, additional amino acids (such as lysine and methionine) non-protein nitrogen supplies (such as urea), (xxv) the period of time is between one week and 52 weeks, (xxvi) the organic acids comprise acetic acid, propionic acid or butyric acid, or any combination thereof, (xxvii) the feedstuff is silage, pellets or hay, and (xxviii) the vegetative plant parts are stored for a period of time before being mixed with the at least one other feed ingredient, (xxiv) the TTQ is about 0.1, or about 0.2 or about 0.3, or about 0.4 or about 0.5, or about 0.6, or about 0.65, or about 0.7, or about 0.75, or about 0.8, or about 0.81, or about 0.82, or about 0.83, or about 0.84, or about 0.85, or about 8.6, or about 8.7, or about 8.8, or about 8.9, or about 0.9, or about 0.91, or about 0.92, or about 0.93, or about 0.94, or about 0.95, in each case where the corresponding wild-type plant part is harvested from a wild-type *Sorghum* sp. or *Zea mays* plant at the same stage of growth.

In a further embodiment of the above aspects, one or more or all of the following features apply:

(i) the vegetative plant parts are leaves and/or stems or parts thereof which comprise one or more of an increased carbon content, an increased energy content, an increased soluble protein content and an increased nitrogen content, each on a weight basis relative to a corresponding wild-type leaf or stem or parts thereof from a wild-type *Sorghum* sp. or *Zea mays* plant at the same stage of growth, (ii) the total fatty acid content of the vegetative plant parts is at least about 8%, at least about 9%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), (iii) the fatty acids esterified in the form of TAG in the vegetative plant parts is at least about 1%, at least about 2%, at least about 3%, at least about 4%, at least about 5%, at least about 6%, at least about 7%, at least about 8%, at least about 9%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), (iv) the vegetative plant parts comprise an increased content of a WRI1 polypeptide, an increased content of a DGAT polypeptide, and a decreased content of a SDP1 polypeptide, each relative to a corresponding wild-type vegetative plant part, (v) the vegetative plant parts comprise an increased content of a WRI1 polypeptide, an increased content of a DGAT polypeptide, and an increased content of a LEC2 polypeptide, each relative to a corresponding wild-type vegetative plant part, (vi) the vegetative plant parts comprise an increased content of a PDAT or DGAT polypeptide, a decreased content of a TGD polypeptide, and a decreased content of a SDP1 polypeptide, each relative to a corresponding wild-type vegetative plant part, and (vii) the vegetative plant parts comprise a decreased content of a TAG lipase polypeptide such as a SDP1 polypeptide, a decreased content of a TGD polypeptide such as a TGD5 polypeptide, and optionally a decreased content of a TST polypeptide such as a TST1 polypeptide, each relative to a corresponding wild-type vegetative plant part.

In an embodiment, the vegetative plant parts comprise an increased content of one or more sucrose metabolism polypeptides selected from the group consisting of an invertase and a sucrose transport polypeptide. The invertase may be a vacuolar invertase or a cytosolic invertase, and the sucrose transport polypeptide may be, for example, a SUS4 or SUT2 that is naturally located to the vacuolar membrane.

In another aspect, the present invention provides a process for feeding an animal, the process comprising providing vegetative plant parts from a *Sorghum* sp. and/or a *Zea mays* plant to the animal, the vegetative plant parts comprising a total fatty acid (TFA) content which comprises fatty acids esterified in the form of triacylglycerols (TAG) and fatty acids in the form of lipids other than TAG, wherein the vegetative plant parts comprise a TFA content of about 5% (w/w dry weight), preferably between about 6% and about 20%.

In an embodiment of the above aspect, the vegetative plant parts have a TTQ of between 0.01 and 0.6. In an embodiment, the vegetative plant parts have a TTQ of between 0.01 and 0.55, or between 0.01 and 0.5, or about 0.1, or about 0.2 or about 0.3, or about 0.4 or about 0.5. Preferably, the TTQ is between 0.60 and 0.84 or between 0.84 and 0.95.

In another aspect, the present invention provides a process for feeding an animal, the process comprising providing vegetative plant parts from a *Sorghum* sp. and/or a *Zea mays* plant to the animal, the vegetative plant parts comprising a total fatty acid content which comprises fatty acids esterified in the form of triacylglycerols (TAG) and fatty acids in the form of lipids other than TAG, wherein the vegetative plant parts comprise a total TAG content of about 6% (w/w dry weight), preferably between about 6% and about 20%, and preferably have a ratio of the fatty acids esterified in the form of TAG to the fatty acids in the form of lipids other than TAG which is between 20:1 and 1.5:1 or between 5:1 and 2:1.

In an embodiment of the two above aspects, one or more or all of the following features apply:
(i) the vegetative plant parts are comprised in a *Sorghum* sp. and/or *Zea mays* plant growing in a field,
(ii) the vegetative plant parts are harvested from the *Sorghum* sp. and/or *Zea mays* plant and/or admixed with at least one other feed ingredient,
(iii) the vegetative plant parts were processed post-harvest, preferably by chopping, cutting, drying, pressing or pelleting the plant parts, into a form that is more suitable for consumption by the animal,
(iv) the harvested plant parts were stored under conditions of reduced oxygen for a period of time such that at least some of the carbohydrates in the plant parts are fermented to organic acids prior to being provided to the animal, and
(v) the harvested plant parts are stored for a period of time between harvest and providing them to the animal.

In a further embodiment of the two above aspects, the animal ingests an increased amount of nitrogen, protein, carbon and/or energy potential relative to when the animal ingests the same amount on a dry weight basis of a corresponding feedstuff produced using an equivalent amount of wild-type *Sorghum* sp. and/or *Zea mays* plant or parts thereof.

In a further embodiment of the two above aspects, the process is further characterised by one or more features as described in the context of the first or second aspects of the invention.

The above two aspects are described in relation to a *Sorghum* sp. and/or *Zea mays* plant. However, it is not intended to limit the described processes to use of only a *Sorghum* sp. or *Zea mays* plant. It is intended that any suitable plant can be used in the processes.

In a further aspect, the present invention provides a feedstuff for an animal, comprising harvested vegetative plant parts from a *Sorghum* sp. and/or a *Zea mays* plant, the vegetative plant parts comprising a total fatty acid (TFA) content which comprises fatty acids esterified in the form of triacylglycerols (TAG) and fatty acids in the form of lipids other than TAG, wherein the vegetative plant parts comprise a TFA content of about 5% (w/w dry weight), preferably between about 6% and about 20%, wherein
(i) the harvested plant parts are mixed with at least one other feed ingredient,
(ii) the harvested plant parts were baled after harvest,
(iii) the harvested plant parts were processed, preferably by chopping, cutting, drying, pressing or pelleting the plant parts, into a form that is suitable for consumption by the animal, and
(iv) the harvested plant parts were stored under conditions of reduced oxygen for a period of time such that at least some of the carbohydrates in the plant parts were fermented to organic acids.

In an embodiment, the vegetative plant parts have a TTQ of between 0.01 and 0.6. In an embodiment, the vegetative plant parts have a TTQ of between 0.01 and 0.55, or between 0.01 and 0.5, or bout 0.1, or about 0.2 or about 0.3, or about 0.4 or about 0.5. Preferably, the TTQ is between 0.60 and 0.84 or between 0.84 and 0.95.

In another aspect, the present invention provides a feedstuff for an animal, comprising harvested vegetative plant parts from a *Sorghum* sp. and/or a *Zea mays* plant, the vegetative plant parts comprising a total fatty acid content which comprises fatty acids esterified in the form of triacylglycerols (TAG) and fatty acids in the form of lipids other than TAG, wherein the vegetative plant parts comprise a total TAG content of about 6% (w/w dry weight), preferably between about 6% and about 20%, and preferably have a ratio of the fatty acids esterified in the form of TAG to the fatty acids in the form of lipids other than TAG which is between 20:1 and 1.5:1 or between 5:1 and 2:1, wherein
(i) the harvested plant parts are mixed with at least one other feed ingredient,
(ii) the harvested plant parts were baled after harvest,
(iii) the harvested plant parts were processed, preferably by chopping, cutting, drying, pressing or pelleting the plant parts, into a form that is suitable for consumption by the animal, and
(iv) the harvested plant parts were stored under conditions of reduced oxygen for a period of time such that at least some of the carbohydrates in the plant parts were fermented to organic acids.

In an embodiment of the two above aspects, the feedstuff is silage, pellets or hay.

In a further embodiment of the two above aspects, the feedstuff is further characterised by one or more features as described in the context of the first or second aspects of the invention.

The above two aspects are described in relation to a *Sorghum* sp. and/or *Zea mays* plant. However, it is not intended to limit the described feedstuffs to comprising vegetative plant parts from a *Sorghum* sp. or *Zea mays* plant. It is intended that the feedstuffs relate more generally to feedstuffs comprising vegetative plant parts from any suitable plant.

In another aspect, the present invention provides a cell, preferably a *Sorghum* sp. or *Zea mays* cell, other than a seed cell, comprising a total fatty acid (TFA) content which comprises fatty acids esterified in the form of triacylglycerols (TAG) and fatty acids in the form of lipids other than TAG, wherein the cell comprises a TFA content of about 5% (w/w dry weight), preferably between about 6% and about 20%.

In an embodiment, the total fatty acid content of the cell has a TTQ of between 0.01 and 0.6. In an embodiment, the total fatty acid content of the cell has a TTQ of between 0.01 and 0.55, or between 0.01 and 0.5, or bout 0.1, or about 0.2 or about 0.3, or about 0.4 or about 0.5. Preferably, the TTQ is between 0.60 and 0.84 or between 0.84 and 0.95.

In an embodiment, the TFA content of the cell comprises an oleic acid content which is increased by at least 2% or at least 3% relative to the oleic acid content of a corresponding wild-type cell.

In an embodiment, the TFA content of the cell comprises a palmitic acid content which is increased by at least 2% or at least 3% relative to the palmitic acid content of a corresponding wild-type cell.

In an embodiment, the TFA content of the cell comprises a α-linoleic acid (ALA) content which is decreased by at least 2% or at least 3% relative to the ALA content of a corresponding wild-type cell.

In an embodiment, the cell is in a vegetative part of a plant and comprises a TAG content of at least about 1%, at least about 2%, at least about 3%, at least about 4%, at least about 5%, at least about 6%, at least about 7%, at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight).

In a further embodiment, the cell is from or in a plant leaf or stem, before the plant flowers, and the cell comprises a TFA content and/or a total non-polar fatty acid content of at least about 6%, at least about 7%, at least about 8%, at least about 10%, at least about 11%, between 8% and 15%, or between 9% and 12% on a weight basis, preferably between about 6% and about 20%.

In another aspect, the present invention provides a cell, preferably a Sorghum sp. or Zea mays cell, other than a seed cell, comprising a total fatty acid content which comprises fatty acids esterified in the form of triacylglycerols (TAG) and fatty acids in the form of lipids other than TAG, wherein the cell comprises a total TAG content of about 6% (w/w dry weight), preferably between about 6% and about 20%, and has a ratio of the fatty acids esterified in the form of TAG to the fatty acids in the form of lipids other than TAG which is between 20:1 and 1.5:1 or between 5:1 and 2:1. In another aspect, the present invention provides a cell, preferably a Sorghum sp. or Zea mays cell, comprising an increased content of a WRI1 polypeptide, an increased content of a DGAT polypeptide, and a decreased content of a SDP1 polypeptide, each relative to a corresponding wild-type cell.

In another aspect, the present invention provides a cell, preferably a Sorghum sp. or Zea mays cell, comprising an increased content of a WRI1 polypeptide, an increased content of a DGAT polypeptide, and an increased content of a LEC2 polypeptide, each relative to a corresponding wild-type cell.

In another aspect, the present invention provides a cell, preferably a Sorghum sp. or Zea mays cell, comprising an increased content of a PDAT or DGAT polypeptide, a decreased content of a TGD polypeptide, preferably a TGD5 polypeptide, and a decreased content of a SDP1 polypeptide, each relative to a corresponding wild-type cell.

In another aspect, the present invention provides a cell, preferably a Sorghum sp. or Zea mays cell, comprising a decreased content of a TAG lipase such as a SDP1 TAG lipase, a decreased content of a TGD polypeptide such as a TGD5 polypeptide, and optionally a decreased content of a TST polypeptide such as a TST1 polypeptide, each decrease being relative to a corresponding wild-type cell.

In an embodiment of the above aspects related to a cell of the invention, one or more or all of the following features apply:
 (i) the cell is in a vegetative plant part which was harvested from a Sorghum sp. or Zea mays plant between the time of first flowering of the plant and first maturity of seed,
 (ii) the cell is a Sorghum bicolor plant cell,
 (iii) the cell is in a leaf or stem or a part thereof,
 (iv) the cell comprises a total lipid content of about 8% or about 10% on a weight basis,
 (v) the total fatty acid content of the cell comprises an oleic acid content which is increased by at least 2% or at least 3% relative to the oleic acid content of a corresponding wild-type cell,
 (vi) the total fatty acid content of the cell comprises a palmitic acid content which is increased by at least 2% or at least 3% relative to the palmitic acid content of a corresponding wild-type cell,
 (vii) the total fatty acid content of the cell comprises a α-linoleic acid (ALA) content which is decreased by at least 2% or at least 3% relative to the ALA content of a corresponding wild-type cell,
 (viii) the cell comprises an increased soluble protein content relative to a corresponding wild-type cell,
 (ix) the cell comprises an increased nitrogen content relative to a corresponding wild-type cell,
 (x) the cell comprises a decreased carbon:nitrogen ratio relative to a corresponding wild-type cell,
 (xi) the cell comprises an increased photosynthetic capacity relative to a corresponding wild-type cell,
 (xii) the cell comprises a decreased starch and/or total dietary fibre (TDF) content relative to a corresponding wild-type cell,
 (xiii) the cell comprises an increased carbon content relative to a corresponding wild-type cell,
 (xiv) the cell comprises an increased transcription factor polypeptide content relative to a corresponding wild-type cell, wherein the transcription factor polypeptide is selected from the group consisting of Wrinkled 1 (WRI1), Leafy Cotyledon 1 (LEC1), LEC1-like, Leafy Cotyledon 2 (LEC2), BABY BOOM (BBM), FUS3, ABI3, ABI4, ABI5, Dof4 and Dof11, or the group consisting of MYB73, bZIP53, AGL15, MYB115, MYB118, TANMEI, WUS, GFR2a1, GFR2a2 and PHR1,
 (xv) the cell comprises an increased fatty acid acyltransferase polypeptide content relative to a corresponding wild-type cell, wherein the acyltransferase is diacylglycerol acyltransferase (DGAT) and/or phospholipid:diacylglycerol acyltransferase (PDAT),
 (xvi) the cell comprises a decreased TAG lipase polypeptide content relative to a corresponding wild-type cell,
 (xvii) the cell comprises a decreased trigalactosyldiacylglycerol (TGD) polypeptide content relative to a corresponding wild-type cell,
 (xviii) the cell comprises an increased content of an oil body coating (OBC) polypeptide or a lipid droplet associated polypeptide (LDAP) relative to a corresponding wild-type cell,
 (xix) the cell comprises an increased total protein content relative to a corresponding wild-type cell,
 (xx) the cell comprises an increased chlorophyll content relative to a corresponding wild-type cell,
 (xxi) the cell comprises an increased energy content on a weight basis relative to a corresponding wild-type cell,
 (xxii) the cell comprises an increased phospholipid and/or galactolipid content relative to a corresponding wild-type cell, preferably an increased MDGD content and/or an increased DGDG content,
 (xxiii) the TTQ is about 0.1, or about 0.2 or about 0.3, or about 0.4 or about 0.5, or about 0.6, or about 0.65, or about 0.7, or about 0.75, or about 0.8, or about 0.81, or about 0.82, or about 0.83, or about 0.84, or about 0.85, or about 8.6, or about 8.7, or about 8.8, or about 8.9, or about 0.9, or about 0.91, or about 0.92, or about 0.93, or about 0.94, or about 0.95, and
 (xxiv) the ratio of the fatty acids esterified in the form of TAG to the fatty acids in the form of lipids other than TAG is between 20:1 and 1.5:1, or between 5:1 and 2:1, or about 4, about 3.5, about 3, or about 2.5.

In an embodiment of the above aspects, the vegetative plant parts or cell of the invention comprises one or both of
a) a first exogenous polynucleotide which encodes a transcription factor polypeptide that increases the expression of one or more glycolytic and/or fatty acid biosynthetic genes in the vegetative plant parts or cell, preferably a WRI1 polypeptide, and
b) a second exogenous polynucleotide which encodes a polypeptide involved in the biosynthesis of one or more non-polar lipids, preferably a DGAT and/or a PDAT,
and in each case any one or two or three or all four of
c) a first genetic modification which down-regulates endogenous production and/or activity of a polypeptide involved in the catabolism of triacylglycerols (TAG) in the vegetative plant parts or cell, preferably an SDP1 TAG lipase, when compared to a corresponding vegetative plant part or cell lacking the genetic modification,
d) a third exogenous polynucleotide which encodes a polypeptide which increases the export of fatty acids out of plastids of the vegetative plant parts or cell when compared to a corresponding vegetative plant part or cell lacking the third exogenous polynucleotide, preferably an acyl-ACP thioesterase polypeptide,
e) a fourth exogenous polynucleotide which encodes a second transcription factor polypeptide that increases the expression of one or more glycolytic and/or fatty acid biosynthetic genes in the vegetative plant parts or cell, preferably a LEC2 polypeptide, and
f) a second genetic modification which down-regulates endogenous production and/or activity of a polypeptide involved in importing fatty acids into plastids of the vegetative plant parts or cell when compared to a corresponding vegetative plant part or cell lacking the second genetic modification, preferably a TGD polypeptide,
wherein each exogenous polynucleotide is operably linked to a promoter which is capable of directing expression of the polynucleotide in the vegetative plant parts or cell.

In an embodiment of the above aspect, the vegetative plant parts or cell further comprises one or both of
a) a fifth exogenous polynucleotide which encodes an oil body coating (OBC) polypeptide or a lipid droplet associated protein (LDAP), and
b) a third genetic modification which down-regulates endogenous production and/or activity of a polypeptide involved in diacylglycerol (DAG) production in the plastid when compared to a corresponding vegetative plant part or cell lacking the third genetic modification.

In an alternate embodiment of the above aspects, the vegetative plant parts or cell comprises
a) a first exogenous polynucleotide which encodes a transcription factor polypeptide that increases the expression of one or more glycolytic and/or fatty acid biosynthetic genes in the vegetative plant parts or cell, preferably a WRI1 polypeptide,
b) a second exogenous polynucleotide which encodes a polypeptide involved in the biosynthesis of one or more non-polar lipids, preferably a DGAT and/or a PDAT,
and any one or two or all three of
c) a first genetic modification which down-regulates endogenous production and/or activity of a polypeptide involved in the catabolism of triacylglycerols (TAG) in the vegetative plant parts or cell when compared to a corresponding vegetative plant part or cell lacking the genetic modification, preferably an SDP1 TAG lipase,
d) a third exogenous polynucleotide which encodes a polypeptide which increases the export of fatty acids out of plastids of the vegetative plant parts or cell when compared to a corresponding vegetative plant part or cell lacking the third exogenous polynucleotide, preferably a acyl-ACP thioesterase polypeptide, and
e) a fourth exogenous polynucleotide which encodes a second transcription factor polypeptide that increases the expression of one or more glycolytic and/or fatty acid biosynthetic genes in the vegetative plant parts or cell, preferably a LEC2 polypeptide,
wherein each exogenous polynucleotide is operably linked to a promoter which is capable of directing expression of the polynucleotide in the vegetative plant parts or cell.

In an embodiment of the above aspect, the vegetative plant parts or cell further comprises one or more or all of
a) a fifth exogenous polynucleotide which encodes an oil body coating (OBC) polypeptide or a lipid droplet associated protein (LDAP),
b) a second genetic modification which down-regulates endogenous production and/or activity of a polypeptide involved in importing fatty acids into plastids of the vegetative plant parts or cell when compared to a corresponding vegetative plant part or cell lacking the second genetic modification, and
c) a third genetic modification which down-regulates endogenous production and/or activity of a polypeptide involved in diacylglycerol (DAG) production in the plastid when compared to a corresponding vegetative plant part or cell lacking the third genetic modification.

In a further embodiment of the above aspects, the vegetative plant parts or cell comprises a first exogenous polynucleotide which encodes a WRI1 polypeptide, a second exogenous polynucleotide which encodes a DGAT polypeptide, and a decreased content of a TAG lipase polypeptide and/or a decreased content of a TGD polypeptide relative to a corresponding wild-type vegetative plant part or cell, wherein each exogenous polynucleotide is operably linked to a promoter which is capable of directing expression of the polynucleotide in the vegetative plant parts or cell.

In another embodiment of the above aspects, the vegetative plant parts or cell comprises an exogenous polynucleotide which encodes a PDAT or DGAT polypeptide, an increased content of the PDAT or DGAT polypeptide, a decreased content of a TGD polypeptide and a decreased content of a TAG lipase polypeptide, each relative to a corresponding wild-type vegetative plant part or cell, wherein the exogenous polynucleotide is operably linked to a promoter which is capable of directing expression of the polynucleotide in the vegetative plant parts or cell.

In another embodiment of the above aspects, the vegetative plant parts or cell comprises a decreased content of a TAG lipase such as a SDP1 TAG lipase, a decreased content of a TGD polypeptide such as a TGD5 polypeptide, and optionally a decreased content of a TST polypeptide such as a TST1 polypeptide, each decrease being relative to a corresponding wild-type vegetative plant part or cell.

In a further embodiment of the above aspects, the cell is from or in a vegetative part of a *Sorghum* sp. or *Zea mays* plant.

In a further embodiment of the above aspects, one or more or all of the following features apply:
i) the vegetative plant parts or cell has an increased synthesis of total fatty acids relative to a corresponding vegetative plant part or cell lacking the first exogenous polynucleotide, or a decreased catabolism of total fatty acids relative to a corresponding vegetative plant part or cell lacking the first exogenous polynucleotide, or both, such that it has an increased level of total fatty acids relative to a corresponding vegetative plant part or cell lacking the first exogenous polynucleotide, ii) the vegetative plant parts or cell has an increased expression and/or activity of a fatty acyl acyltransferase which catalyses the synthesis of TAG, DAG or MAG, preferably TAG, relative to a corresponding vegetative plant part or cell having the first exogenous polynucleotide and lacking the exogenous polynucleotide which encodes a polypeptide involved in the biosynthesis of one or more non-polar lipids, iii) the vegetative plant parts or cell has a decreased production of lysophosphatidic acid (LPA) from acyl-ACP and G3P in its plastids relative to a corresponding vegetative plant part or cell having the first exogenous polynucleotide and lacking the genetic modification which down-regulates endogenous production and/or activity of a polypeptide involved in diacylglycerol (DAG) production in the plastid in the vegetative plant parts or cell, iv) the vegetative plant parts or cell has an altered ratio of C16:3 to C18:3 fatty acids in its total fatty acid content and/or its galactolipid content relative to a corresponding vegetative plant part or cell lacking the exogenous polynucleotide(s) and/or genetic modification(s), preferably a decreased ratio, v) the cell is in a vegetative part of a plant and comprises a total non-polar lipid content of at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), vi) the cell is in a vegetative part of a plant and comprises a TAG content of at least about 1%, at least about 2%, at least about 3%, at least about 4%, at least about 5%, at least about 6%, at least about 7%, at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between about 6% and about 20%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), vii) the transcription factor polypeptide is selected from the group consisting of Wrinkled 1 (WRI1), Leafy Cotyledon 1 (LEC1), LEC1-like, Leafy Cotyledon 2 (LEC2), BABY BOOM (BBM), FUS3, ABI3, ABI4, ABI5, Dof4 and Dof11, viii) oleic acid comprises at least 20% (mol %), at least 22% (mol %), at least 30% (mol %), at least 40% (mol %), at least 50% (mol %), or at least 60% (mol %), preferably about 65% (mol %) or between 20% and about 65% of the total fatty acid content in the vegetative plant parts or cell, ix) non-polar lipid in the vegetative plant parts or cell comprises one or more polyunsaturated fatty acids selected from eicosadienoic acid (EDA), arachidonic acid (ARA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA), or a combination of two of more thereof, x) one or more or all of the promoters are selected from a constitutive promoter such as a ubiquitin gene promoter or an actin gene promoter, a tissue-specific promoter such as a leaf and/or stem specific promoter, a developmentally regulated promoter such as a senescence-specific promoter such as a SAG12 promoter, an inducible promoter, or a circadian-rhythm regulated promoter, xi) the vegetative plant parts or cell comprises a total fatty acid content whose oleic acid level is increased by at least 2% or at least 3% relative to a corresponding vegetative plant part or cell lacking the exogenous polynucleotide(s) and/or genetic modification(s), and/or whose α-linolenic acid (ALA) level is decreased by at least 2% or at least 3% relative to a corresponding vegetative plant part or cell lacking the exogenous polynucleotide(s) and/or genetic modification(s), xii) non-polar lipid in the vegetative plant parts or cell comprises a modified level of total sterols, preferably free (non-esterified) sterols, steroyl esters, steroyl glycosides, relative to the non-polar lipid in a corresponding vegetative plant part or cell lacking the exogenous polynucleotide(s) and/or genetic modification(s), xiii) the level of one or more non-polar lipid(s) and/or the total non-polar lipid content of the vegetative plant parts or cell is at least 2% greater on a weight basis than in a corresponding vegetative plant parts or cell which comprises exogenous polynucleotides encoding an Arabidposis *thaliana* WRI1 (SEQ ID NO:21) and an *Arabidopsis thaliana* DGAT1 (SEQ ID NO:1).

In a further embodiment of the above aspects, one or more or all of the following features apply where relevant;

i) the polypeptide involved in the biosynthesis of one or more non-polar lipids is a fatty acyl acyltransferase involved in the biosynthesis of TAG, DAG or monoacylglycerol (MAG) in the cell, such as a DGAT, PDAT, LPAAT, GPAT or MGAT, preferably a DGAT or a PDAT, or is a PDCT or a CPT polypeptide, or a PLC or PLD polypeptide, ii) the polypeptide involved in the catabolism of triacylglycerols (TAG) in the vegetative plant parts or cell is an SDP1 lipase, a Cgi58 polypeptide, an acyl-CoA oxidase such as ACX1 or ACX2, or a polypeptide involved in β-oxidation of fatty acids in the vegetative plant parts or cell such as a PXA1 peroxisomal ATP-binding cassette transporter, preferably an SDP1 lipase, iii) the oil body coating (OBC) polypeptide is oleosin, such as a polyoleosin or a caleosin, or a lipid droplet associated protein (LDAP), iv) the polypeptide which increases the export of fatty acids out of plastids of the vegetative plant parts or cell is a C16 or C18 fatty acid thioesterase such as a FATA polypeptide or a FATB polypeptide, a fatty acid transporter such as an ABCA9 polypeptide or a long-chain acyl-CoA synthetase (LACS), v) the polypeptide involved in importing fatty acids into plastids of the vegetative plant parts or cell is a fatty acid transporter, or subunit or regulatory polypoeptide thereof, preferably a TGD polypeptide, more preferably a TGD5 polypeptide, and vi) the polypeptide involved in diacylglycerol (DAG) production in the plastid is a plastidial GPAT, a plastidial LPAAT or a plastidial PAP.

In an embodiment of the above aspects, the level or activity of PDCT or CPT, or both PDCT and CPT, is increased in the vegetative plant part, seed or cell of the invention relative to the wild-type. In a preferred embodiment, the vegetative plant part, seed or cell of the invention comprises one or more exogenous polynucleotides which encode a PDCT and/or CPT polypeptide. The PDCT and/or CPT polypeptide may be endogenous to the the vegetative plant part, seed or cell i.e. of the same species but at an increased level or activity relative to the wild-type, or heterologous to the plant species. Each exogenous polynucleotide is operably linked to a promoter which is expressed in the vegetative plant part, seed or cell, to provide the increased level or activity of PDCT and/or CPT. In a preferred embodiment, the increased level or activity of PDCT and/or CPT provides for an increased rate of conversion of DAG to phosphatidylcholine (PC), or from PC to DAG, or more preferably of both of these. The vegetative plant part, seed or cell thereby has an increased production of DAG produced from PC, which DAG is available for production of TAG by the activity of DGAT. In a more preferred embodiment, the level of TAG in the vegetative plant part, seed or cell is increased relative to a corresponding part or cell which lacks the exogenous polynucleotides.

Alternatively, the level or activity of PDCT or CPT is decreased, or of both PDCT and CPT are decreased, in the vegetative plant part, seed or cell of the invention relative to the wild-type, for example by mutation in the endogenous gene encoding the enzyme(s) or by downregulation of the gene(s) encoding the enzyme(s) by an RNA molecule which reduces its expression. In this embodiment, there is a reduced conversion of DAG produced via the Kennedy pathway (de novo DAG) to PC, resulting in an increased level of de novo DAG available for synthesis of TAG in the vegetative plant part, seed or cell.

In an embodiment of the above aspects, the level or activity of phospholipase-C (PLC) or phospholipase-D (PLD), or both PLC and PLD, is increased in the vegetative plant part, seed or cell of the invention relative to the wild-type. In a preferred embodiment, the vegetative plant part, seed or cell of the invention comprises one or more exogenous polynucleotides which encode a PLC and/or PLD polypeptide. The PLC and/or PLD polypeptide may be endogenous to the vegetative plant part or cell but at an increased level or activity relative to the wild-type, or heterologous to the plant species. The exogenous polynucleotide is operably linked to a promoter which is expressed in the vegetative plant part or cell, to provide the increased level or activity of PLC and/or PLD. In a preferred embodiment, the increased level or activity of PLC and/or PLD provides for an increased rate of conversion of PC to DAG and phosphocholine in the case of PLC, or phosphatidic acid (PA) and choline in the case of PLD. PA is subsequently converted to DAG by the action of PAP. The vegetative plant part or cell thereby has an increased amount of DAG available for production of TAG by the activity of DGAT. In a more preferred embodiment, the level or activity of TAG in the vegetative plant part or cell is increased relative to a corresponding part or cell which lacks the exogenous polynucleotides encoding the PLC and/or PLD. In a preferred embodiment, the increased level or activity of PLC and/or PLD is in combination with an increased level or activity of PDCT and/or CPT, as described above.

In an embodiment of the above aspects, the level or activity of PDAT is increased in the vegetative plant part or cell of the invention, relative to the wild-type. In a preferred embodiment, the vegetative plant part or cell comprises one or more exogenous polynucleotides which encode a PDAT polypeptide. The PDAT polypeptide may be endogenous to the vegetative plant part or cell but at an increased level or activity relative to the wild-type, or heterologous to the plant species. The exogenous polynucleotide is operably linked to a promoter which is expressed in the vegetative plant part or cell, to provide the increased level or activity of PDAT. It is desired that the increased level or activity of PDAT provides for an increased production of TAG from DAG and PC. In a preferred embodiment, the increased level or activity of PDAT is in combination with an increased level or activity of PDCT and/or CPT, or with an increased level or activity of PLC and/or PLD, as described above.

In an embodiment of the above aspects, the level or activity of two different DGATs is increased in the vegetative plant part or cell of the invention relative to the wild-type. In a preferred embodiment, the vegetative plant part or cell of the invention comprises two exogenous polynucleotides which each encode a DGAT polypeptide, the polypeptides being different. One of the DGAT polypeptides may be endogenous to the vegetative plant part or cell but at an increased level or activity relative to the wild-type, while the other is heterologous, or both DGATs are heterologous to the plant species. The exogenous polynucleotides are each operably linked to a promoter which is expressed in the vegetative plant part or cell, to provide for increased expression of both DGATs. It is desired that the increased level or activity of two DGATs provides for an increased production of TAG produced from de novo DAG and from PC-derived DAG. In a preferred embodiment, one of the DGATs (a first DGAT) is more active on de novo DAG than PC-derived DAG, whereas the other DGAT (a second DGAT) is more active on PC-derived DAG than de novo DAG. Such differences in the DGAT activities may occur by different compartmentalisation or localisation of the two DGATs in the endoplasmic reticulum (ER) of the cell. In an embodiment, one of the DGATs is derived from a unicellular organism, for example a bacterial DGAT or a unicellular algal DGAT such as a *Chlamydomonas* DGAT or a variant thereof. In a preferred embodiment, the first DGAT is derived from a plant species which naturally produces oil which has a low level of polyunsaturated fatty acids (PUFA), e.g. less than 20% PUFA, or a DGAT homolog thereof which is at least 95% identical in amino acid sequence, and the second DGAT is derived from an oilseed species which produces a relatively higher level of PUFA, e.g. at least 40% PUFA, or a DGAT homolog thereof which is at least 95% identical in amino acid sequence. For example, the first DGAT may be from olive, coconut, palm or mangosteen, and the second DGAT may be from *Brassica*, soybean, cotton or linseed. Typically, the first DGAT is more active on de novo DAG and the second DGAT is more active on PC-derived DAG. In a preferred embodiment, the increased activity of two DGATs is in combination with an increased level or activity of PDCT and/or CPT, or with an increased level or activity of PLC and/or PLD, or an increased level or activity of PDAT, as described above.

In the above embodiments, the extent of the increase of a level or activity is preferably by at least 10% or at least 20% to a maximum of 100% or 200% increase. The extent of the decrease of a level or activity is preferably by at least 10% or 20%, to a maximum decrease of 90% or 95%, or even 100% decrease.

In the above embodiments, the increased levels or activities result in an increased TTQ in the total lipid of the vegetative plant part or cell of the invention and/or an increased level of TAG relative to a corresponding vegetative plant part or cell lacking the respective exogenous polynucleotides. In a further embodiment of the above aspects, the cell of the invention is from or in a plant leaf or stem, before the plant flowers, and the cell comprises a TFA content and/or a total non-polar fatty acid content of at least about 6%, at least about 8%, at least about 10%, at least about 11%, between 8% and 15%, or between 9% and 12% on a weight basis, preferably between about 8% and about 20%.

In a further embodiment of the above aspects, each genetic modification is independently a mutation of an endogenous gene which partially or completely inactivates the gene, such as a point mutation, an insertion or a deletion, or the genetic modification is an exogenous polynucleotide encoding an RNA molecule which reduces expression of the endogenous gene, wherein the exogenous polynucleotide is operably linked to a promoter which is capable of directing expression of the polynucleotide in the vegetative plant parts or cell.

In a further aspect, the present invention provides a plant, preferably a *Sorghum* sp. or *Zea mays* plant or part thereof, the plant comprising a vegetative plant part whose total fatty acid (TFA) content comprises fatty acids esterified in the form of triacylglycerols (TAG) and fatty acids in the form of lipids other than TAG, wherein the vegetative plant part comprises a TFA content of about 5% (w/w dry weight), preferably between about 6% and about 20%. In an embodiment, the plant part is a seed or seeds obtained from the plant, or a seed or seeds which when sown give rise to such a plant.

In another aspect, the present invention provides a plant, preferably a *Sorghum* sp. or *Zea mays* plant or part thereof, the plant comprising a vegetative plant part whose total fatty acid content comprises fatty acids esterified in the form of triacylglycerols (TAG) and fatty acids in the form of lipids other than TAG, wherein the vegetative plant part comprises a total TAG content of about 6% (w/w dry weight), preferably between about 6% and about 20%, and preferably has a ratio of the fatty acids esterified in the form of TAG to the fatty acids in the form of lipids other than TAG which is between 20:1 and 1.5:1 or between 5:1 and 2:1.

In another aspect, the present invention provides a plant, preferably, a *Sorghum* sp. or *Zea mays* plant or part thereof, the plant comprising a vegetative plant part comprising an increased content of a WRI1 polypeptide, an increased content of a DGAT polypeptide, and a decreased content of a SDP1 polypeptide, each relative to a corresponding wild-type vegetative plant part.

In another aspect, the present invention provides a plant, preferably, a *Sorghum* sp. or *Zea mays* plant or part thereof, the plant comprising a vegetative plant part comprising an increased content of a WRI1 polypeptide, an increased content of a DGAT polypeptide, and an increased content of a LEC2 polypeptide, each relative to a corresponding wild-type vegetative plant part.

In another aspect, the present invention provides a plant, preferably, a *Sorghum* sp. or *Zea mays* plant or part thereof, the plant comprising a vegetative plant part comprising an increased content of a PDAT or DGAT polypeptide, a decreased content of a TGD polypeptide, preferably a TGD5 polypeptide, and a decreased content of a SDP1 polypeptide, each relative to a corresponding wild-type vegetative plant part.

In another aspect, the present invention provides a plant, preferably a *Sorghum* sp. or *Zea mays* plant or part thereof, the plant comprising a vegetative plant part comprising a decreased content of a TAG lipase such as a SDP1 TAG lipase, a decreased content of a TGD polypeptide such as a TGD5 polypeptide, and optionally a decreased content of a TST polypeptide such as a TST1 polypeptide, each decrease being relative to a corresponding wild-type vegetative plant part.

In another aspect, the present invention provides a plant, preferably a *Sorghum* sp. or *Zea mays* plant, or part thereof, the plant comprising a vegetative part comprising an increased level or activity of PDCT and/or CPT relative to the wild-type. In an embodiment, the plant or part comprises one or more exogenous polynucleotides which encode a PDCT and/or CPT polypeptide. The PDCT and/or CPT polypeptide may be endogenous to the plant or part but present at an increased level relative to the wild-type, or heterologous to the plant species. Each exogenous polynucleotide is operably linked to a promoter which is expressed in the vegetative plant part, to provide the increased level or activity of PDCT and/or CPT. In a preferred embodiment, the increased level or activity of PDCT and/or CPT provides for an increased rate of conversion of DAG to PC, or from PC to DAG, or more preferably of both of these. The vegetative plant part thereby has an increased amount of DAG available for production of TAG by the activity of DGAT. In a more preferred embodiment, the level of TAG in the vegetative plant part is increased relative to a corresponding part which lacks the exogenous polynucleotides.

In another aspect, the present invention provides a plant, preferably a *Sorghum* sp. or *Zea mays* plant, or part thereof, the plant comprising a vegetative plant part comprising a decreased level or activity of PDCT and/or CPT relative to the wild-type. In an embodiment, the plant or part comprises a mutation in an endogenous gene(s) encoding the enzyme(s) or one or more exogenous polynucleotides which each encode an RNA molecule which reduces expression of one or both of the endogenous genes encoding the enzymes.

In another aspect, the present invention provides a plant, preferably a *Sorghum* sp. or *Zea mays* plant, or part thereof, the plant comprising a vegetative part comprising an increased level or activity of PLC or PLD, or both. In a preferred embodiment, the plant or part comprises one or more exogenous polynucleotides which encode a PLC and/or a PLD polypeptide. The PLC and/or PLD polypeptide may be endogenous to the plant or part but at an increased level or activity relative to the wild-type, or heterologous to the plant species. Each exogenous polynucleotide is operably linked to a promoter which is expressed in the vegetative plant part, to provide the increased level or activity of PLC and/or PLD. In a preferred embodiment, the increased level or activity of PLC and/or PLD provides for an increased rate of conversion of PC to DAG and phosphocholine in the case of PLC, or PA and choline in the case of PLD. The vegetative part thereby has an increased amount of DAG available for production of TAG by the activity of DGAT. In a more preferred embodiment, the level of TAG in the vegetative plant part is increased relative to a corresponding part which lacks the exogenous polynucleotides encoding the PLC and/or PLD.

In another aspect, the present invention provides a palnt, preferably a *Sorghum* sp. or *Zea mays* plant, or part thereof, the plant comprising an increased level or activity of PDAT in a vegetative part relative to the wild-type. In a preferred embodiment, the vegetative part comprises one or more exogenous polynucleotides which encode a PDAT polypeptide. The PDAT polypeptide may be endogenous to the vegetative part but at an increased level or activity relative to the wild-type, or heterologous to the plant species. The exogenous polynucleotide is operably linked to a promoter which is expressed in the vegetative plant part, to provide an increased level or activity of PDAT. It is desired that the increased level or activity of PDAT provides for an increased production of TAG from DAG and PC. In a preferred embodiment, the increased level or activity of PDAT is in combination with an increased level or activity of PDCT and/or CPT, or with an increased level or activity of PLC and/or PLD, as described above.

In another aspect, the present invention provides a plant, preferably a *Sorghum* sp. or *Zea mays* plant, or part thereof, the plant comprising an increased level or activity of two different DGATs in a vegetative part relative to the wild-type. In a preferred embodiment, the plant or part thereof comprises two exogenous polynucleotides which each encode a DGAT polypeptide, the polypeptides being different. One of the DGAT polypeptides may be endogenous to the plant or part but at an increased level or activity relative to the wild-type, while the other is heterologous, or both DGATs are heterologous to the plant species. The exogenous polynucleotides are each operably linked to a promoter which is expressed in the vegetative part, to provide for increased expression of each of the DGATs. It is desired that the increased level or activity of the two DGATs provides for (i) an increased production of TAG produced from de novo DAG and (ii) an increased production of TAG produced from DAG which is produced from PC (PC-derived DAG). In an embodiment, a first DGAT is more active on de novo DAG than PC-derived DAG, whereas a second DGAT is more active on PC-derived DAG than de novo DAG. Such differences in the DGAT activities may occur by different compartmentalisation or localisation of the two DGATs in the endoplasmic reticulum (ER) of the cell. In an embodiment, one of the DGATs is derived from a unicellular organism, for example a bacterial DGAT or a unicellular algal DGAT such as a *Chlamydomonas* DGAT or a variant thereof. In a preferred embodiment, the first DGAT is derived from a plant part which produces oil which has a low level of polyunsaturated fatty acids (PUFA), e.g. less than 20% PUFA, whereas the second DGAT is derived from an oilseed which produces a relatively higher level of PUFA, e.g. at least 40% PUFA. Typically the first DGAT is more active on de novo DAG and the second DGAT is more active on PC-derived DAG. In a preferred embodiment, the increased activity of two DGATs is in combination with an increased activity of PDCT and/or CPT, or with an increased activity of PLC and/or PLD, or an increased activity of PDAT, as described above.

Combinations of the features of the above aspects are clearly contemplated for the plant, plant part and cell of the invention, and in the processes of producing and using them.

In an embodiment of the above aspects, the plant of the invention is phenotypically normal. In an embodiment, the plant of the invention has an above-ground biomass which is at least 80% relative to a corresponding wild-type plant. Preferably, the plant has a plant height which is at least 80% relative to the corresponding wild-type plant, and is male and female fertile. In an embodiment, the plant is a hybrid *Zea mays* plant.

In an embodiment of the above aspects, the vegetative plant part of the plant of the invention has a total fatty acid content characterised by a TTQ of between 0.01 and 0.6. In an embodiment, the vegetative plant part has a TTQ of between 0.01 and 0.55, or between 0.01 and 0.5, or bout 0.1, or about 0.2 or about 0.3, or about 0.4 or about 0.5. Preferably, the TTQ is between 0.60 and 0.84 or between 0.84 and 0.95.

In a preferred embodiment of the above aspects, the cell or vegetative plant part of the invention comprises one or more exogenous polynucleotides or genetic modifications which each, or in combination, increase the TTQ of the total fatty acid content of the cell or vegetative plant part relative to a corresponding cell or vegetative plant part which lacks the exogenous polynucleotide or genetic modification, wherein the exogenous polynucleotide or genetic modification provides for (i) a decreased TAG lipase polypeptide content, preferably a decreased SDP1 polypeptide content, (ii) a decreased TGD polypeptide content, preferably a decreased TGD5 polypeptide content, (iii) an increased content of an OBC polypeptide or a LDAP, (iv) an increased content of a polypeptide which increases the export of fatty acids out of plastids, preferably an acyl-ACP thioesterase, (v) a decreased TST polypeptide content, preferably a decreased TST1 polypeptide content, (vi) a modified level of a PDCT polypeptide, (vii) a modified level of a CPT polypeptide, (viii) an increased level or activity of a PLC polypeptide, (ix) an increased level or activity of a PLD polypeptide, (x) an increased level or activity of a PDAT polypeptide, and (xi) an increased level or activity of two DGAT polypeptides. More preferably, the TTQ is between 0.60 and 0.84 or between 0.84 and 0.95, and/or the cell or vegetative plant part comprises a TAG content of about 6% (w/w dry weight), preferably between about 6% and about 20%.

In an embodiment of the above aspects, the plant or part thereof comprises one or both of
a) a first exogenous polynucleotide which encodes a transcription factor polypeptide that increases the expression of one or more glycolytic and/or fatty acid biosynthetic genes in the plant or part thereof, preferably a WRI1 polypeptide, and
b) a second exogenous polynucleotide which encodes a polypeptide involved in the biosynthesis of one or more non-polar lipids, preferably a DGAT and/or a PDAT, and in each case any one or two or three or all four of
c) a genetic modification which down-regulates endogenous production and/or activity of a polypeptide involved in the catabolism of triacylglycerols (TAG) in the plant or part thereof when compared to a corresponding plant or part thereof lacking the genetic modification, preferably an SDP1 TAG lipase,
d) a third exogenous polynucleotide which encodes a polypeptide which increases the export of fatty acids out of plastids of a cell in the plant or part thereof when compared to a corresponding cell lacking the third exogenous polynucleotide, preferably an acyl-ACP thioesterase,
e) a fourth exogenous polynucleotide which encodes a second transcription factor polypeptide that increases the expression of one or more glycolytic and/or fatty acid biosynthetic genes in a cell in the plant or part thereof, preferably a LEC2 polypeptide, and f) a second genetic modification which down-regulates endogenous production and/or activity of a polypeptide involved in importing fatty acids into plastids of the cell when compared to a corresponding cell lacking the second genetic modification, wherein each exogenous polynucleotide is operably linked to a promoter which is capable of directing expression of the polynucleotide in the plant or part thereof.

In an embodiment of the above aspects, the plant or part thereof further comprises one or both of
  a) a fifth exogenous polynucleotide which encodes an oil body coating (OBC) polypeptide or a lipid droplet associated protein (LDAP), and
  b) a third genetic modification which down-regulates endogenous production and/or activity of a polypeptide involved in diacylglycerol (DAG) production in plastids when compared to a corresponding plant or part thereof lacking the third genetic modification.

Alternately, in a further embodiment, the plant or part thereof comprises
  a) a first exogenous polynucleotide which encodes a transcription factor polypeptide that increases the expression of one or more glycolytic and/or fatty acid biosynthetic genes in the plant or part thereof, preferably a WRI1 polypeptide,
  b) a second exogenous polynucleotide which encodes a polypeptide involved in the biosynthesis of one or more non-polar lipids, preferably a DGAT polypeptide and/or a PDAT polypeptide, and any one or two or all three of
  c) a genetic modification which down-regulates endogenous production and/or activity of a polypeptide involved in the catabolism of triacylglycerols (TAG) in the plant or part thereof, preferably an SDP1 TAG lipase, when compared to a corresponding plant or part thereof lacking the genetic modification,
  d) a third exogenous polynucleotide which encodes a polypeptide which increases the export of fatty acids out of plastids of a cell in the plant when compared to a corresponding cell lacking the third exogenous polynucleotide, preferably an acyl-ACP thioesterase, and
  e) a fourth exogenous polynucleotide which encodes a second transcription factor polypeptide that increases the expression of one or more glycolytic and/or fatty acid biosynthetic genes in a cell in the plant or part thereof, preferably a LEC2 polypeptide,
wherein each exogenous polynucleotide is operably linked to a promoter which is capable of directing expression of the polynucleotide in the plant or part thereof.

In an embodiment of the above aspect, the plant or part thereof further comprises one or more or all of
  a) a fifth exogenous polynucleotide which encodes an oil body coating (OBC) polypeptide,
  b) a second genetic modification which down-regulates endogenous production and/or activity of a polypeptide involved in importing fatty acids into plastids of the plant when compared to a corresponding plant lacking the second genetic modification, and
  c) a third genetic modification which down-regulates endogenous production and/or activity of a polypeptide involved in diacylglycerol (DAG) production in the plastid when compared to a corresponding plant lacking the third genetic modification.

In a further embodiment of the above aspects, the plant part is a vegetative plant part and one or more or all of the promoters are expressed at a higher level in the vegetative plant part relative to seed of the plant. For example, a preferred promoter is a ubiquitin gene promoter or an SSU promoter. Alternatively, one or more or all of the promoters are other than an SSU promoter.

In a further embodiment, the plant or part thereof is further characterised by one or more features as described in the context of the cell of the invention, or of the processes of the above aspects.

In an embodiment of the above aspects, a *Sorghum* sp. or *Zea mays* plant of the invention, or a plant or part thereof used in a method of the invention or otherwise described herein, has been grown under a photoperiod of at least 13 hours per day for a period of at least 1 week, or at least 2 weeks or at least 3 weeks or at least 4 weeks, preferably up to when the plant is harvested to obtain vegetative parts from the plant. Under such conditions, the above-ground biomass of the plant is preferable at least 80% relative to a corresponding wild-type plant. Seed of the plant may be harvested from the plant after growth under such conditions.

In another embodiment of the above aspects, a *Sorghum* sp. or *Zea mays* plant of the invention, or a plant or part thereof used in a method of the invention or otherwise defined herein, was/is grown in a $CO_2$ concentration of at least 400 ppm.

In a further embodiment, a *Sorghum* sp. or *Zea mays* plant of the invention, or a plant or part thereof used in a method of the invention or otherwise described herein comprises one or more exogenous polynucleotides encoding one or more proteins which increase the total protein content in the vegetative plant part.

In another aspect, the present invention provides a population of at least about 1000 plants, each being a plant according to the invention, growing in a field, or a collection of at least about 1000 vegetative plant parts, each being a vegetative plant part according to the invention, wherein the vegetative plant parts have been harvested from plants growing in a field. Preferably the plants were grown under the photoperiod and/or $CO_2$ conditions described above.

In another aspect, the present invention provides seed of, or obtained from, a plant according to the invention, or which when sown give rise to plants of the invention. Alternatively, the seed may have been treated so it is no longer able to germinate, and/or be ground, milled, polished, cracked or heat treated.

In a further aspect, the present invention provides a process for identifying, selecting and/or obtaining a plant or part thereof of the invention, preferably a *Sorghum* sp. or *Zea mays* plant or a part thereof, with a desired phenotype, the process comprising
  i) obtaining a plurality of candidate plants, or parts thereof, which each comprise one or both of
    a) a first exogenous polynucleotide which encodes a transcription factor polypeptide that increases the expression of one or more glycolytic and/or fatty acid biosynthetic genes in the plant or part thereof, preferably a WRI1 polypeptide, and
    b) a second exogenous polynucleotide which encodes a polypeptide involved in the biosynthesis of one or more non-polar lipids, preferably a DGAT polypeptide and/or a PDAT polypeptide, and in each case any one or two or three or all four of
    c) a genetic modification which down-regulates endogenous production and/or activity of a polypeptide involved in the catabolism of triacylglycerols (TAG) in the plant or part thereof when compared to a corresponding plant or part thereof lacking the genetic modification, preferably a SDP1 TAG lipase, d) a third exogenous polynucleotide which encodes a polypeptide which increases the export of fatty acids out of plastids of a cell in the plant or part thereof when compared to a corresponding cell lacking the third exogenous polynucleotide, preferably an acyl-ACP thioesterase, e) a fourth exogenous polynucleotide which encodes a second transcription factor polypeptide that increases the expression of one or more glycolytic and/or fatty acid biosynthetic genes in a cell in the plant or part thereof, preferably a LEC2 polypeptide, and f) a second genetic modification which down-regulates endogenous production and/or activity of a polypeptide involved in importing fatty acids into plastids of the cell when compared to a corresponding cell lacking the second genetic modification, wherein each exogenous polynucleotide is operably linked to a promoter which is capable of directing expression of the polynucleotide in the plant;

ii) analysing lipid in the plurality of parts, or at least a part of each plant in the plurality of candidate plants, from step i), and iii) identifying, selecting and/or obtaining a plant, or part thereof, which comprises a vegetative plant part whose total fatty acid (TFA) content comprises fatty acids esterified in the form of triacylglycerols (TAG) and fatty acids in the form of lipids other than TAG, and which has a vegetative plant part which comprises a TFA content of about 5% (w/w dry weight), preferably between about 6% and about 20%.

In an embodiment, a plant is selected, or a part thereof, which comprises a vegetative plant part whose total fatty acid content is characterised by having a TTQ of between 0.01 and 0.6. In an embodiment, a plant is selected, or part thereof, wherein the plant comprises a vegetative plant part having a TTQ of between 0.01 and 0.55, or between 0.01 and 0.5, or bout 0.1, or about 0.2 or about 0.3, or about 0.4 or about 0.5. In a preferred embodiment, the TTQ is between 0.60 and 0.84 or between 0.84 and 0.95.

In another aspect, the present invention provides a process for identifying, selecting and/or obtaining a plant, preferably a *Sorghum* sp. or *Zea mays* plant, or a part thereof with a desired phenotype, the process comprising i) obtaining a plurality of candidate plants, or parts thereof, which each comprise one or both of a) a first exogenous polynucleotide which encodes a transcription factor polypeptide that increases the expression of one or more glycolytic and/or fatty acid biosynthetic genes in the plant or part thereof, preferably a WRI1 polypeptide, b) a second exogenous polynucleotide which encodes a polypeptide involved in the biosynthesis of one or more non-polar lipids, preferably a DGAT polypeptide and/or a PDAT polypeptide, and any one or two or all three of c) a genetic modification which down-regulates endogenous production and/or activity of a polypeptide involved in the catabolism of triacylglycerols (TAG) in the plant or part thereof, preferably an SDP1 TAG lipase, when compared to a corresponding plant or part thereof lacking the genetic modification, d) a third exogenous polynucleotide which encodes a polypeptide which increases the export of fatty acids out of plastids of a cell in the plant or part thereof when compared to a corresponding cell lacking the third exogenous polynucleotide, preferably an acyl-ACP thioesterase, and e) a fourth exogenous polynucleotide which encodes a second transcription factor polypeptide that increases the expression of one or more glycolytic and/or fatty acid biosynthetic genes in a cell in the plant or part thereof, preferably a LEC2 polypeptide, wherein each exogenous polynucleotide is operably linked to a promoter which is capable of directing expression of the polynucleotide in the plant or part thereof;

ii) analysing lipid in the plurality of parts, or at least a part of each plant in the plurality of candidate plants, from step i), iii) identifying, selecting and/or obtaining a plant or part thereof wherein the plant comprises a vegetative plant part whose total fatty acid content comprises fatty acids esterified in the form of triacylglycerols (TAG) and fatty acids in the form of lipids other than TAG, and which has a vegetative plant part which comprises a total TAG content of about 6% (w/w dry weight), preferably between about 6% and about 20%, and preferably has a ratio of the fatty acids esterified in the form of TAG to the fatty acids in the form of lipids other than TAG which is between 20:1 and 1.5:1 or between 5:1 and 2:1.

In another aspect, the present invention provides a process for identifying selecting and/or obtaining a plant, preferably a *Sorghum* sp. or *Zea mays* plant, or a part thereof, having an increased TTQ in its total fatty acid content, the process comprising i) obtaining a plurality of candidate plants, or parts thereof, which each comprise one or more genetic modifications which provides for (a) a decreased TAG lipase polypeptide content or activity, preferably a decreased SDP1 TAG lipase content or activity, (b) a decreased TGD polypeptide content or activity, preferably a decreased TGD5 polypeptide content or activity, (c) an increased content of an OBC polypeptide or a LDAP, (d) an increased content or activity of a polypeptide which increases the export of fatty acids out of plastids, preferably an acyl-ACP thioesterase, (e) a decreased TST polypeptide content or activity, preferably a decreased TST1 polypeptide content or activity, (f) a modified level or activity of a PDCT polypeptide, (g) a modified level or activity of a CPT polypeptide, (h) an increased content or activity of a PLC polypeptide, (i) an increased content or activity of PLD polypeptide, (j) an increased content or activity of a PDAT polypeptide, and (k) an increased content or activity of two DGAT polypeptides, ii) analysing lipid in the plurality of plants, or at least a part of each plant in the plurality of candidate plants, from step i), iii) identifying, selecting and/or obtaining a plant or part thereof which comprises an increased TTQ in its total fatty acid content relative to a corresponding plant or plant part which lacks the genetic modifications or relative to another plant or plant part from the plurality of candidate plants or parts thereof.

In an embodiment of the above aspect, the increased TTQ is increased by at least 0.05, preferably between 0.5 and 0.80. Each of the one or more genetic modifications, when expressed in the candidate plants or part thereof, results in a decreased polypeptide content or activity according to (a), (b) or (e), an increased content or activity according to (c), (d), (h), (i), (j) or (k), and either an increased or decreased content and or activity for (f) or (g). In the case of a decreased polypeptide content or activity, each genetic modification is, independently, a mutation of an endogenous gene encoding the polypeptide which partially or completely inactivates the gene, such as a point mutation, an insertion, or preferably a deletion, or the genetic modification comprises the integration into the genome of an exogenous polynucleotide which encodes an RNA molecule which inhibits expression of the endogenous gene, wherein the exogenous polynucleotide is operably linked to a promoter which is capable of directing expression of the polynucleotide in the plant or part thereof.

In an embodiment, step (ii) of the process of the above aspects comprises extracting lipid from the candidate plants or parts thereof, and one or more of (a) separating TAG from non-TAG lipid in the plants or parts thereof, (b) determining the relative amounts of TAG and non-TAG lipid in the extracted lipid. In an embodiment, the process comprises a step of calculating the TTQ for the candidate plants or parts, after step ii). The identified or selected plant may be identified or selected on the basis of the TTQ and/or of its TAG or TFA content. In a preferred embodiment, the identified selected plant comprises a vegetative plant part which has a TTQ which is between 0.60 and 0.84 or between 0.84 and 0.95, and/or the vegetative plant part comprises a TAG content of about 6% (w/w dry weight), preferably between about 6% and about 20%.

In an embodiment of the process of the above aspects, the process further comprises a step of propagating the plant or part thereof of the invention to obtain progeny plants or parts thereof, for example from seed or vegetative parts from the plant, or of crossing the plant with a plant of different genetic composition to introduce the genetic modification(s) into a different genetic background. The invention clearly includes the progeny plants and parts thereof which comprise the genetic modification(s) and an increased TTQ in their total fatty acid content.

In a more preferred embodiment of the process of the above aspects, the plurality of candidate plants, or parts thereof, each comprise a first exogenous polynucleotide which encodes a transcription factor polypeptide that increases the expression of one or more glycolytic and/or fatty acid biosynthetic genes in the plant or part thereof, preferably a WRI1 polypeptide, and a second exogenous polynucleotide which encodes a polypeptide involved in the biosynthesis of one or more non-polar lipids, preferably a DGAT polypeptide and/or a PDAT polypeptide. In this preferred embodiment, the genetic modification(s) which results in the decreased, increased or modified polypeptide content or activity according to (a) to (k) is additional to the first and second exogenous polynucleotides, and increases the TTQ relative to a corresponding plant or vegetative part which has the first and second exogenous polynucleotides but lacks the genetic modification(s).

In an embodiment of the process of the above aspects, the plant, or part thereof which is identified, selected and/or obtained is further characterised by one or more features as defined in the context of a plant of the invention, the *Sorghum* sp. or *Zea mays* plant of the invention, or of the processes of the above aspects.

The process for identifying, selecting and/or obtaining a plant of the invention can also be used to identify, select and/or obtain a plant which has an increased TTQ or TAG content in a stem of the plant, which preferably is accompanied by an increased TTQ or TAG content in leaves of the plant, although the TTQ and TAG content in leaves of the plant may not be increased at all or as much as in the stem.

In another aspect, the present invention provides a process for obtaining a cell or plant according to the invention, preferably a *Sorghum* sp. or *Zea mays* cell or plant, the process comprising the steps of introducing into a cell or plant, preferably a *Sorghum* sp. or *Zea mays* cell or plant, at least one exogenous polynucleotide and/or at least one genetic modification as defined above.

In an embodiment, the process comprises one or more or all steps of
  i) expressing the exogenous polynucleotide(s) and/or genetic modifications in the cell or plant or a progeny cell or plant therefrom,
  ii) analysing the lipid content of the cell or plant or progeny cell or plant, and
  iii) selecting or identifying a cell or plant according to the invention.

The obtained cell may be in a *Sorghum* or *Zea mays* plant or preferably in a vegetative part thereof.

In an embodiment, the exogenous polynucleotide(s) and/or genetic modifications provide for a modified feature which comprises a decreased, increased, or modified polypeptide content according to (a) to (k) above. In an embodiment, the process comprises a step of calculating the TTQ for the candidate plants or parts, after step ii). In a preferred embodiment, the cell or plant is selected or identified on the basis of its TTQ and/or its TAG content, more preferably a TTQ which is between 0.60 and 0.84 or between 0.84 and 0.95, and/or the vegetative plant part comprises a TAG content of about 6% (w/w dry weight), preferably between about 6% and about 20%.

In another aspect, the present invention provides a method of producing a plant, preferably a *Sorghum* sp. or *Zea mays* plant, which has integrated into its genome a set of exogenous polynucleotides and/or genetic modifications as defined herein, the method comprising the steps of
  i) crossing two parental plants, wherein one plant comprises at least one of the exogenous polynucleotides and/or at least one genetic modification as defined above, and the other plant comprises at least one of the exogenous polynucleotides and/or at least one genetic modification as defined above, and wherein between them the two parental plants comprise a set of exogenous polynucleotides and/or genetic modifications as defined above,
  ii) screening one or more progeny plants from the cross for the presence or absence of the set of exogenous polynucleotides and/or genetic modifications as defined above, and
  iii) selecting a progeny plant which comprise the set of exogenous polynucleotides and/or genetic modifications as defined above,
thereby producing the plant.

In an embodiment, the plant, or part thereof which is produced is further characterised by one or more features as described in the context of a cell or plant of the invention, preferably a *Sorghum* sp. or *Zea mays* cell or plant, or of the processes of the above aspects.

In another aspect, the present invention provides a process for producing an oil product, the process comprising the steps of
  (i) treating, in a reactor, a composition comprising
    (a) vegetative plant parts, preferably *Sorghum* sp. or *Zea mays* vegetative plant parts whose total fatty acid (TFA) content comprises fatty acids esterified in the form of triacylglycerols (TAG) and fatty acids in the form of lipids other than TAG, wherein the vegetative plant part comprises a TFA content of about 5% (w/w dry weight), preferably at least 10%,
(b) a solvent which comprises water, an alcohol, or both, and
(c) optionally a catalyst, wherein the treatment comprises heating the composition at a temperature between about 50° C. and about 450° C. and at a pressure between 5 and 350 bar for between 1 and 120 minutes in an oxidative, reductive or inert environment,
(ii) recovering oil product from the reactor at a yield of at least 35% by weight relative to the dry weight of the vegetative plant parts, thereby producing the oil product.

In an embodiment, the vegetative plant parts have a TTQ of between 0.01 and 0.6. In an embodiment, the vegetative plant parts have a TTQ of between 0.01 and 0.55, or between 0.01 and 0.5, or bout 0.1, or about 0.2 or about 0.3, or about 0.4 or about 0.5. Preferably, the TTQ is between 0.60 and 0.84 or between 0.84 and 0.95.

In another aspect, the present invention provides a process for producing an oil product, the process comprising the steps of
(i) treating, in a reactor, a composition comprising
(a) vegetative plant parts, preferably Sorghum sp. or Zea mays vegetative plant parts whose total fatty acid content comprises fatty acids esterified in the form of triacylglycerols (TAG) and fatty acids in the form of lipids other than TAG, wherein the vegetative plant part comprises a total TAG content of about 6% (w/w dry weight) and preferably has a ratio of the fatty acids esterified in the form of TAG to the fatty acids in the form of lipids other than TAG which is between 20:1 and 1.5:1 or between 5:1 and 2:1,
(b) a solvent which comprises water, an alcohol, or both, and
(c) optionally a catalyst, wherein the treatment comprises heating the composition at a temperature between about 50° C. and about 450° C. and at a pressure between 5 and 350 bar for between 1 and 120 minutes in an oxidative, reductive or inert environment,
(ii) recovering oil product from the reactor at a yield of at least 35% by weight relative to the dry weight of the vegetative plant parts, thereby producing the oil product.

In an embodiment of the two above aspects, one or more or all of the following apply:
(i) the vegetative plant parts have a dry weight of at least 1 kg,
(ii) the vegetative plant parts have a TFA content and/or a total non-polar lipid content of at least 10%, at least 15%, at least 20%, about 25%, about 30%, about 35%, or between 30% and 75% on a dry weight basis,
(iii) the composition has a solids concentration between 5% and 90%,
(iv) the catalysts comprises NaOH or KOH or both, preferably at a concentration of 0.1M to 2M,
(v) the treatment time is between 1 and 60 minutes, preferably between 10 and 60 minutes, more preferably between 15 and 30 minutes,
(vi) if the solvent is water the process produces a yield of the oil product between a minimum of 36%, 37%, 38%, 39% or 40% and a maximum of 55% or 60% by weight relative to the dry weight of the vegetative plant parts,
(vii) if the solvent comprises an alcohol the process produces a yield of the oil product between a minimum of 36%, 37%, 38%, 39% or 40% and a maximum of 65% or 70% by weight relative to the dry weight of the vegetative plant parts,
(viii) if the solvent comprises about 80% water, the oil product comprises about 30% of C13-C22 hydrocarbon compounds,
(ix) if the solvent comprises about 50% methanol, the oil product comprises about 50% fatty acid methyl esters (FAME),
(x) the recovered oil product has a water content of less than about 15% by weight,
(xi) the yield of oil product is at least 2% greater by weight relative to a corresponding process using corresponding vegetative plant parts whose non-polar lipid content is less than 2% on a dry weight basis, and
(xii) the vegetative plant parts in step (i)(a) have been physically processed by one or more of drying, chopping, shredding, milling, rolling, pressing, crushing or grinding.

In a further embodiment of the two above aspects, the process further comprises one or more of:
(i) hydrodeoxygenation of the recovered oil product,
(ii) treatment of the recovered oil product with hydrogen to reduce the levels of ketones or sugars in the oil product,
(iii) production of syngas from the recovered oil product, and
(iv) fractionating the recovered oil product to produce one or more of fuel oil, diesel oil, kerosene or gasoline.

In a further embodiment of the two above aspects, the vegetative plant parts comprise plant leaves, stems or both.

In an embodiment of the two above aspects, the vegetative plant parts which are treated are further characterised by one or more features as defined in the context of the Sorghum sp. or Zea mays plant parts or cells of the invention.

In another aspect, the present invention provides a process for producing an industrial product, the process comprising the steps of:
i) obtaining a cell according to the invention, preferably a Sorghum sp. or Zea mays cell, a plant or part thereof of the invention, preferably a Sorghum sp. or Zea mays plant or part thereof, or a seed of the invention, and
ii) either
a) converting at least some of the lipid in the cell, plant or part thereof, or seed of step i) to the industrial product by applying heat, chemical, or enzymatic means, or any combination thereof, to the lipid in situ in the cell, plant or part thereof, or seed, or
b) physically processing the cell, plant or part thereof, or seed of step i), and subsequently or simultaneously converting at least some of the lipid in the processed cell, plant or part thereof, or seed to the industrial product by applying heat, chemical, or enzymatic means, or any combination thereof, to the lipid in the processed cell, plant or part thereof, or seed, and
iii) recovering the industrial product,
thereby producing the industrial product.

In an embodiment, the plant part is a vegetative plant part of the invention.

In an embodiment, the step of physically processing the cell, plant or part thereof, or seed comprises one or more of rolling, pressing, crushing or grinding the cell, plant or part thereof, or seed. The industrial product is as described herein.

In a further embodiment, the process further comprises the steps of:

(a) extracting at least some of the non-polar lipid content of the cell, plant or part thereof, or seed as non-polar lipid, and (b) recovering the extracted non-polar lipid, wherein steps (a) and (b) are performed prior to the step of converting at least some of the lipid in the cell, plant or part thereof, or seed to the industrial product.

The extracted non-polar lipid preferably comprises triacylglycerols, wherein the triacylglycerols comprise at least 90%, more preferably at least 95%, of the extracted lipid.

In another aspect, the present invention provides a process for producing extracted lipid, the process comprising the steps of:
 i) obtaining a cell according to the invention, preferably a *Sorghum* sp. or *Zea mays* cell, a plant or part thereof of the invention, preferably a *Sorghum* sp. or *Zea mays* plant or part thereof, or a seed of the invention,
 ii) extracting lipid from the cell, plant or part thereof, or seed, and
 iii) recovering the extracted lipid, thereby producing the extracted lipid.

In an embodiment, the step of extraction comprises one or more of drying, rolling, pressing, crushing or grinding the plant or part thereof, or seed, and/or purifying the extracted lipid or seedoil. In an embodiment, the process uses an organic solvent in the extraction process to extract the oil.

In an embodiment, the process comprises recovering the extracted lipid by collecting it in a container and/or one or more of degumming, deodorising, decolourising, drying, fractionating the extracted lipid, removing at least some waxes and/or wax esters from the extracted lipid, or analysing the fatty acid composition of the extracted lipid.

In an embodiment, the volume of the extracted lipid or oil is at least 1 litre.

In a further embodiment, one or more or all of the following features apply:
 (i) the extracted lipid or oil comprises triacylglycerols, wherein the triacylglycerols comprise at least 90%, preferably at least 95% or at least 96%, of the extracted lipid or oil,
 (ii) the extracted lipid or oil comprises free sterols, steroyl esters, steroyl glycosides, waxes or wax esters, or any combination thereof, and
 (iii) the total sterol content and/or composition in the extracted lipid or oil is significantly different to the sterol content and/or composition in the extracted lipid or oil produced from a corresponding plant or part thereof, or seed.

In a further embodiment, the process further comprises converting the extracted lipid to an industrial product.

In a further embodiment, the industrial product is a hydrocarbon product such as fatty acid esters, preferably fatty acid methyl esters and/or a fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar.

In a further embodiment, the plant part is an aerial plant part or a green plant part, preferably a vegetative plant part such as a plant leaf or stem.

In yet a further embodiment, the step of obtaining the plant or part thereof comprises a step of harvesting the plant or part thereof with a mechanical harvester.

In another embodiment, the level of a lipid in the plant or part thereof, or seed and/or in the extracted lipid or oil is determinable by analysis by using gas chromatography of fatty acid methyl esters prepared from the extracted lipid or oil.

In another embodiment, the plant part is a vegetative plant part which comprises a total TAG content of at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight).

In an embodiment of the above aspects, the cells, plants or parts thereof or seeds which are used are further characterised by one or more features as defined in the context of the plant parts or cells of the invention, preferably the *Sorghum* sp. or *Zea mays* plant parts or cells.

In another aspect, the present invention provides a process for producing seed, the process comprising:
 i) growing a plant according to the invention, and
 ii) harvesting seed from the plant.

In an embodiment, the process comprises growing a population of at least about 1,500, at least about 3,000 or at least about 5,000 plants, each being a plant of the invention, and harvesting seed from the population of plants.

In another aspect, the present invention provides recovered or extracted lipid or soluble protein obtainable from a cell according to the invention, preferably a *Sorghum* sp. or *Zea mays* cell, a plant or part thereof of the invention, preferably a *Sorghum* sp. or *Zea mays* plant or part thereof, a seed of the invention, or obtainable by a process of the invention.

In another aspect, the present invention provides an industrial product produced by the process according to the invention, which is a hydrocarbon product such as fatty acid esters, preferably fatty acid methyl esters and/or a fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar.

In another aspect, the present invention provides use of a cell according to the invention, preferably a *Sorghum* sp. or *Zea mays* cell, a plant or part thereof of the invention, preferably a *Sorghum* sp. or *Zea mays* plant or part thereof, a seed of the invention, or the recovered or extracted lipid of the invention for the manufacture of an industrial product. Examples of industrial products of the invention include those described in the previous aspect.

In another aspect, the present invention provides a process for producing fuel, the process comprising:
 i) reacting the lipid of the invention with an alcohol, optionally, in the presence of a catalyst, to produce alkyl esters, and
 ii) optionally, blending the alkyl esters with petroleum based fuel.

In another aspect, the present invention provides a process for producing a synthetic diesel fuel, the process comprising:
 i) converting the lipid in a cell according to the invention, preferably a *Sorghum* sp. or *Zea mays* cell, a plant or part thereof of the invention, preferably a *Sorghum* sp. or *Zea mays* plant or part thereof, or a seed of the invention to a bio-oil by a process comprising pyrolysis or hydrothermal processing or to a syngas by gasification, and ii) converting the bio-oil to synthetic diesel fuel by a process comprising fractionation, preferably selecting hydrocarbon compounds which condense between about 150° C. to about 200° C. or between about 200° C. to about 300° C., or converting the syngas to a biofuel using a metal catalyst or a microbial catalyst.

In another aspect, the present invention provides a process for producing a biofuel, the process comprising converting the lipid in a cell according to the invention, preferably a *Sorghum* sp. or *Zea mays* cell, a plant or part thereof of the invention, preferably a *Sorghum* sp. or *Zea mays* plant or part thereof, or a seed of the invention to bio-oil by pyrolysis, a bioalcohol by fermentation, or a biogas by gasification or anaerobic digestion.

In an embodiment, the part is a vegetative plant part.

The present inventors have also demonstrated significant modifications in traits of transgenic plants, or parts thereof such as vegetative parts, by manipulation of lipid pathways.

Thus, in another aspect, the present invention provides a transgenic plant, or part thereof, preferably a *Sorghum* sp. or *Zea mays* plant or part thereof, comprising
 a) a first exogenous polynucleotide which encodes a transcription factor polypeptide that increases the expression of one or more glycolytic and/or fatty acid biosynthetic genes in the plant or part thereof, preferably a WRI1 polypeptide,
 b) a second exogenous polynucleotide which encodes a polypeptide involved in the biosynthesis of one or more non-polar lipids, preferably a DGAT polypeptide and/or a PDAT polypeptide,
 c) an increased triacylglycerol (TAG) content in the part or at least a part of the transgenic plant relative to a corresponding wild-type plant or part thereof, and one or more or all of the following phenotypes;
 d) an increased soluble protein content in the part or at least a part of the transgenic plant relative to a corresponding wild-type plant or part thereof,
 e) an increased nitrogen content in the part or at least a part of the transgenic plant relative to a corresponding wild-type plant or part thereof,
 f) decreased carbon:nitrogen ratio in the part or at least a part of the transgenic plant relative to a corresponding wild-type plant or part thereof,
 g) increased photosynthetic gene expression in the part or at least a part of the transgenic plant relative to a corresponding wild-type plant or part thereof,
 h) increased photosynthetic capacity in the part or at least a part of the transgenic plant relative to a corresponding wild-type plant or part thereof,
 i) decreased total dietary fibre (TDF) content in the part or at least a part of the transgenic plant relative to a corresponding wild-type plant or part thereof,
 j) increased carbon content in the part or at least a part of the transgenic plant relative to a corresponding wild-type plant or part thereof,
 k) increased energy content in the part or at least a part of the transgenic plant relative to a corresponding wild-type plant or part thereof, and
 l) an increased TTQ relative to a corresponding wild-type plant or part thereof,
wherein each exogenous polynucleotide is operably linked to a promoter which is capable of directing expression of the polynucleotide in the plant, or part thereof.

In an embodiment, the plant or part thereof is derived from an ancestor transgenic plant which comprises the first and second exogenous polynucleotides, wherein the ancestor transgenic plant was selected from a plurality of candidate transgenic plants each comprising the first and second exogenous polynucleotides on the basis that the ancestor transgenic plant comprised one or more or all of the following phenotypes;
 a) an increased soluble protein content in at least a part of the transgenic plant relative to a corresponding wild-type plant or part thereof,
 b) an increased nitrogen content in at least a part of the transgenic plant relative to a corresponding wild-type plant or part thereof,
 c) decreased carbon:nitrogen ratio in at least a part of the transgenic plant relative to a corresponding wild-type plant or part thereof,
 d) increased photosynthetic gene expression in at least a part of the transgenic plant relative to a corresponding wild-type plant or part thereof,
 e) increased photosynthetic capacity in at least a part of the transgenic plant relative to a corresponding wild-type plant or part thereof,
 f) decreased total dietary fibre (TDF) content in at least a part of the transgenic plant relative to a corresponding wild-type plant or part thereof,
 g) increased carbon content in at least a part of the transgenic plant relative to a corresponding wild-type plant or part thereof, and
 h) increased energy content in at least a part of the transgenic plant relative to a corresponding wild-type plant or part thereof.

In another aspect, the present invention provides a transgenic plant, or part thereof, preferably a *Sorghum* sp. or *Zea mays* plant or part thereof, comprising
 a) a first exogenous polynucleotide which encodes a transcription factor polypeptide that increases the expression of one or more glycolytic and/or fatty acid biosynthetic genes in the plant or a part thereof, preferably a WRI polypeptide,
 b) a second exogenous polynucleotide which encodes a polypeptide involved in the biosynthesis of one or more non-polar lipids, preferably a DGAT polypeptide and/or a PDAT polypeptide,
 c) an increased triacylglycerol (TAG) content in the part or at least a part of the transgenic plant relative to a corresponding wild-type plant or part thereof,
wherein each exogenous polynucleotide is operably linked to a promoter which is capable of directing expression of the polynucleotide in the plant, or part thereof, and wherein the transgenic plant is derived from an ancestor transgenic plant which comprises the first and second exogenous polynucleotides, wherein the ancestor transgenic plant was selected from a plurality of candidate transgenic plants each comprising the first and second exogenous polynucleotides on the basis that the ancestor transgenic plant comprised one or more or all of the following phenotypes;
 i) an increased soluble protein content in at least a part of the transgenic plant relative to a corresponding wild-type plant or part thereof,
 ii) an increased nitrogen content in at least a part of the transgenic plant relative to a corresponding wild-type plant or part thereof,
 iii) decreased carbon:nitrogen ratio in at least a part of the transgenic plant relative to a corresponding wild-type plant or part thereof, iv) increased photosynthetic gene expression in at least a part of the transgenic plant relative to a corresponding wild-type plant or part thereof, v) increased photosynthetic capacity in at least a part of the transgenic plant relative to a corresponding wild-type plant or part thereof, vi) decreased total dietary fibre (TDF) content in at least a part of the transgenic plant relative to a corresponding wild-type plant or part thereof, vii) increased carbon content in at least a part of the transgenic plant relative to a corresponding wild-type plant or part thereof, viii) increased energy content in at least a part of the transgenic plant relative to a corresponding wild-type plant or part thereof, and ix) an increased TTQ and/or increased TAG content relative to a corresponding wild-type plant or part thereof.

In an embodiment of the above two aspects, the plant or part thereof has one or more or all of;

i) an increased soluble protein content in at least a part of the transgenic plant relative to a corresponding wild-type plant or part thereof, ii) an increased nitrogen content in at least a part of the transgenic plant relative to a corresponding wild-type plant or part thereof, iii) decreased carbon:nitrogen ratio in at least a part of the transgenic plant relative to a corresponding wild-type plant or part thereof.

In an embodiment, the plant or part thereof has one or more or all of;

i) the plant or part thereof has an increased soluble protein content in the part or at least a part of the transgenic plant relative to the corresponding wild-type plant or part thereof of at least about 10%, at least about 25%, at least about 50%, at least about 75%, at least about 100%, between about 10% and about 200%, between about 50% and about 150%, or between about 50% and about 125%, ii) the plant or part thereof has an increased nitrogen content in the part or at least a part of the transgenic plant relative to the corresponding wild-type plant or part thereof of at least about 10%, at least about 25%, at least about 50%, at least about 75%, at least about 100%, between about 10% and about 200%, between about 50% and about 150% or between about 50% and about 125%, iii) the part is a leaf which has an increased soluble protein content relative to a corresponding wild-type leaf of at least about 10%, at least about 25%, at least about 50%, at least about 75%, at least about 100%, between about 10% and about 200%, between about 50% and about 150%, or between about 50% and about 125%, iv) the part is a leaf which has an increased nitrogen content relative to a corresponding wild-type leaf of at least about 10%, at least about 25%, at least about 50%, at least about 75%, at least about 100%, between about 10% and about 200%, between about 50% and about 150%, or between about 50% and about 125%, v) the plant or part thereof has a decreased carbon:nitrogen content in the part or at least a part of the transgenic plant relative to the corresponding wild-type plant or part thereof of at least about 10%, at least about 25%, at least about 40%, between about 10% and about 50%, or between about 25% and about 50%, vi) expression of one or more genes involved in photosynthesis is increased in the plant or part thereof relative to the corresponding wild-type plant or part thereof, vii) the plant or part thereof has an increased carbon content in the part or at least a part of the transgenic plant relative to the corresponding wild-type plant or part thereof of at least about 10%, at least about 25%, at least about 50%, at least about 75%, at least about 100%, at least about 125%, at least about 150%, between about 10% and about 300%, between about 50% and about 250%, or between about 100% and about 200%, viii) the plant or part thereof has an increased energy content in the part or at least a part of the transgenic plant relative to the corresponding wild-type plant or part thereof of at least about 10%, at least about 25%, at least about 50%, at least about 75%, at least about 100%, at least about 125%, at least about 150%, at least about 200%, at least about 250%, between about 10% and about 400%, between about 50% and about 300%, or between about 200% and about 300%, ix) the plant or part thereof has an decreased starch content in the part or at least a part of the transgenic plant relative to the corresponding wild-type plant or part thereof of at least about 2 fold, at least about 5 fold, at least about 10 fold, at least about 15 fold, at least about 20 fold, at least about 25 fold, between about 5 fold and about 35 fold, between about 10 fold and about 30 fold, or between about 20 fold and about 30 fold, x) the plant or part thereof has an decreased TDF content in the part or at least a part of the transgenic plant relative to the corresponding wild-type plant or part thereof of at least about 10%, at least about 30%, at least about 50%, between about 10% and about 70%, or between about 30% and about 65%, and xi) the plant or part thereof has a soluble sugar content in the part or at least a part of the transgenic plant relative to the corresponding wild-type plant or part thereof which is about 0.5 fold to 2 fold.

In another embodiment, the plant or part thereof further comprises one or more or all of;

a) a first genetic modification which down-regulates endogenous production and/or activity of a polypeptide involved in the catabolism of triacylglycerols (TAG) in the plant, or part thereof, preferably a SDP1 TAG lipase, when compared to a corresponding plant, or part thereof, lacking the genetic modification, b) a third exogenous polynucleotide which encodes a polypeptide which increases the export of fatty acids out of plastids of the plant when compared to a corresponding plant lacking the third exogenous polynucleotide, preferably an acyl-ACP thioesterase, c) a fourth exogenous polynucleotide which encodes a second transcription factor polypeptide that increases the expression of one or more glycolytic and/or fatty acid biosynthetic genes in the plant, or part thereof, preferably a LEC2 polypeptide, d) a fifth exogenous polynucleotide which encodes an oil body coating (OBC) polypeptide, e) a second genetic modification which down-regulates endogenous production and/or activity of a polypeptide involved in importing fatty acids into plastids of the plant when compared to a corresponding plant lacking the second genetic modification, and f) a third genetic modification which down-regulates endogenous production and/or activity of a polypeptide involved in diacylglycerol (DAG) production in the plastid when compared to a corresponding plant lacking the third genetic modification, wherein each exogenous polynucleotide is operably linked to a promoter which is capable of directing expression of the polynucleotide in the plant, or part thereof.

In a preferred embodiment, the presence of the first genetic modification, the third exogenous polynucleotide or the fourth exogenous polynucleotide, together with the first and second exogenous polynucleotides increases the total non-polar lipid content of the plant or part thereof, preferably a vegetative plant part such as a leaf or stem, relative to a corresponding plant or part thereof which comprises the first and second exogenous polynucleotides but lacking each of first genetic modification, the third exogenous polynucleotide and the fourth exogenous polynucleotide. More preferably, the increase is synergistic. Most preferably, at least the promoter that directs expression of the first exogenous polynucleotide is a promoter other than a constitutive promoter. Alternatively for *Sorghum* or *Zea mays*, the promoter is preferably a constitutive promoter such as, for example a ubiquitin gene promoter.

In an embodiment, the addition of one or more of the exogenous polynucleotides or genetic modifications, preferably the exogenous polynucleotide encoding an OBC or a fatty acyl thioesterase or the genetic modification which down-regulates endogenous production and/or activity of a polypeptide involved in the catabolism of triacylglycerols (TAG) in the plant or part thereof, more preferably the exogenous polynucleotide which encodes a FATA thioesterase or an LDAP or which decreases expression of an endogenous TAG lipase such as a SDP1 TAG lipase in the plant or part thereof, results in a synergistic increase in the total non-polar lipid content of the plant or part thereof when added to the pair of transgenes WRI1 and DGAT, particularly before the plant flowers and even more particularly in the stems and/or roots of the plant. For example, see Examples 8, 11 and 15. In a preferred embodiment, the increase in the TAG content of a stem or root of the plant is at least 2-fold, more preferably at least 3-fold, relative to a corresponding plant or part thereof transformed with genes encoding WRI1 and DGAT1 but lacking the FATA thioesterase, LDAP and the genetic modification which down-regulates endogenous production and/or activity of a polypeptide involved in the catabolism of triacylglycerols (TAG) in the plant or part thereof. Most preferably, at least the promoter that directs expression of the first exogenous polynucleotide is a promoter other than a constitutive promoter. Alternatively for *Sorghum* or *Zea mays*, the promoter is preferably a constitutive promoter such as, for example a ubiquitin gene promoter.

In an embodiment, each genetic modification is, independently, a mutation of an endogenous gene which partially or completely inactivates the gene, such as a point mutation, an insertion, or a deletion, or an exogenous polynucleotide encoding an RNA molecule which inhibits expression of the endogenous gene, wherein the exogenous polynucleotide is operably linked to a promoter which is capable of directing expression of the polynucleotide in the plant, or part thereof. The point mutation may be a premature stop codon, a splice-site mutation, a frame-shift mutation or an amino acid substitution mutation that reduces activity of the gene or the encoded polypeptide. The deletion may be of one or more nucleotides within a transcribed exon or promoter of the gene, or extend across or into more than one exon, or extend to deletion of the entire gene. Preferably the deletion is introduced by use of ZF, TALEN or CRISPR technologies.

In an alternate embodiment, one or more or all of the genetic modifications is an exogenous polynucleotide encoding an RNA molecule which reduces expression of the endogenous gene, wherein the exogenous polynucleotide is operably linked to a promoter which is capable of directing expression of the polynucleotide in the plant, or part thereof. Examples of exogenous polynucleotides which reduce expression of an endogenous gene are selected from the group consisting of an antisense polynucleotide, a sense polynucleotide, a microRNA, a polynucleotide which encodes a polypeptide which binds the endogenous enzyme, a double stranded RNA molecule and a processed RNA molecule derived therefrom. In an embodiment, the plant or part thereof comprises genetic modifications which are an introduced mutation in an endogenous gene and an exogenous polynucleotide encoding an RNA molecule which reduces expression of another endogenous gene. Alternatively, all of the genetic modifications that provide for the increased TTQ and or TAG levels are mutations of endogenous genes.

In an embodiment, the plant or part thereof has one or more or all of;
i) the transcription factor polypeptide is selected from the group consisting of Wrinkled 1 (WRI1), Leafy Cotyledon 1 (LEC1), LEC1-like, Leafy Cotyledon 2 (LEC2), BABY BOOM (BBM), FUS3, ABI3, ABI4, ABI5, Dof4 and Dof11, or the group consisting of MYB73, bZIP53, AGL15, MYB115, MYB118, TANMEI, WUS, GFR2a1, GFR2a2 and PHR1,
ii) the polypeptide involved in the biosynthesis of one or more non-polar lipids is a fatty acyl acyltransferase which is involved in the biosynthesis of TAG, DAG or monoacylglycerol (MAG) in the plant or part thereof, such as a DGAT, PDAT, LPAAT, GPAT or MGAT, preferably a DGAT or a PDAT, or a PDCT or a CPT polypeptide, or a PLC or PLD polypeptide,
iii) the polypeptide involved in the catabolism of triacylglycerols (TAG) in the plant, or part thereof, is an SDP1 lipase, a Cgi58 polypeptide, an acyl-CoA oxidase such as ACX1 or ACX2, or a polypeptide involved in β-oxidation of fatty acids in the plant or part thereof such as a PXA1 peroxisomal ATP-binding cassette transporter, preferably an SDP1 lipase,
iv) the oil body coating (OBC) polypeptide is oleosin, such as a polyoleosin or a caleosin, or a lipid droplet associated protein (LDAP), preferably a non-allergenic OBC,
v) the polypeptide which increases the export of fatty acids out of plastids of the plant or part thereof is a C16 or C18 fatty acid thioesterase such as a FATA polypeptide or a FATB polypeptide, a fatty acid transporter such as an ABCA9 polypeptide or a long-chain acyl-CoA synthetase (LACS),
vi) the polypeptide involved in importing fatty acids into plastids of the plant or part thereof is a fatty acid transporter, or subunit thereof, preferably a TGD polypeptide, and
vii) the polypeptide involved in diacylglycerol (DAG) production in the plastid is a plastidial GPAT, a plastidial LPAAT or a plastidial PAP.

In an embodiment, the activity of PDCT or CPT in the cell or vegetative plant part is increased relative to a wild-type cell or vegetative plant part. Alternatively, the activity of PDCT or CPT is decreased, for example by mutation in the endogenous gene encoding the enzyme or by downregulation of the gene through an RNA molecule which reduces its expression.

In an embodiment, the polypeptide involved in the biosynthesis of one or more non-polar lipids is a DGAT or a PDAT and the polypeptide involved in the catabolism of TAG in the plant or part thereof is an SDP1 lipase.

In an embodiment, the transcription factor polypeptide that increases the expression of one or more glycolytic and/or fatty acid biosynthetic genes in the plant or part thereof is a WRI1 polypeptide and the polypeptide involved in the biosynthesis of one or more non-polar lipids is a DGAT or a PDAT.

In an embodiment, the transcription factor polypeptide that increases the expression of one or more glycolytic and/or fatty acid biosynthetic genes in the plant or part thereof is a WRI1 polypeptide, a LEC2 polypeptide, a LEC1 polypeptide or a LEC1-like polypeptide and the polypeptide involved in the biosynthesis of one or more non-polar lipids is a DGAT.

In an embodiment, the transcription factor polypeptide that increases the expression of one or more glycolytic and/or fatty acid biosynthetic genes in the plant or part thereof is a WRI1 polypeptide, a LEC2 polypeptide, a LEC1 polypeptide or a LEC1-like polypeptide and the polypeptide involved in the catabolism of triacylglycerols (TAG) in the plant or part thereof is an SDP1 lipase.

In an embodiment, the transcription factor polypeptide that increases the expression of one or more glycolytic and/or fatty acid biosynthetic genes in the plant or part thereof is a WRI1 polypeptide, a LEC2 polypeptide, a LEC1 polypeptide or a LEC1-like polypeptide, the polypeptide involved in the biosynthesis of one or more non-polar lipids is a DGAT or a PDAT and the polypeptide involved in the catabolism of triacylglycerols (TAG) in the plant or part thereof is an SDP1 lipase.

In an embodiment, the transcription factor polypeptide that increases the expression of one or more glycolytic and/or fatty acid biosynthetic genes in the plant is a WRI1 polypeptide, a LEC2 polypeptide, a LEC1 polypeptide or a LEC1-like polypeptide, and the polypeptide involved in importing fatty acids into plastids of the plant or part thereof is a TGD polypeptide.

In an embodiment, the transcription factor polypeptide that increases the expression of one or more glycolytic and/or fatty acid biosynthetic genes in the plant is a WRI1 polypeptide, a LEC2 polypeptide, a LEC1 polypeptide or a LEC1-like polypeptide, and the polypeptide involved in diacylglycerol (DAG) production is a plastidial GPAT.

In an embodiment, the transcription factor polypeptide that increases the expression of one or more glycolytic and/or fatty acid biosynthetic genes in the plant is a WRI1 polypeptide, a LEC2 polypeptide, a LEC1 polypeptide or a LEC1-like polypeptide, the polypeptide which increases the export of fatty acids out of plastids of the plant is a fatty acid thioesterase, preferably a FATA or a FATB polypeptide, and the polypeptide involved in importing fatty acids into plastids of the plant is a TGD polypeptide.

In an embodiment, the transcription factor polypeptide that increases the expression of one or more glycolytic and/or fatty acid biosynthetic genes in the plant is a WRI1 polypeptide, a LEC2 polypeptide, a LEC1 polypeptide or a LEC1-like polypeptide, the polypeptide which increases the export of fatty acids out of plastids of the plant is a fatty acid thioesterase, preferably a FATA or a FATB polypeptide, and the polypeptide involved in diacylglycerol (DAG) production is a plastidial GPAT.

In an embodiment, the transcription factor polypeptide that increases the expression of one or more glycolytic and/or fatty acid biosynthetic genes in the plant is a WRI1 polypeptide, a LEC2 polypeptide, a LEC1 polypeptide or a LEC1-like polypeptide, the polypeptide involved in importing fatty acids into plastids of the plant a TGD polypeptide, and the polypeptide involved in diacylglycerol (DAG) production is a plastidial GPAT.

In an embodiment, when present, the two transcription factors are WRI1 and LEC2, or WRI1 and LEC1.

In the above embodiments, the plant or part thereof preferably comprises an exogenous polynucleotide which encodes a DGAT and a genetic modification which down-regulates production of an endogenous SDP1 lipase. More preferably, the plant or part thereof does not comprise an exogenous polynucleotide encoding a PDAT, and/or is a plant or part thereof other than a *Nicotiana benthamiana* or part thereof, and/or the WRI1 is a WRI1 other than *Arabidopsis thaliana* WRI1 (SEQ ID NOs:21 or 22) and/or is a plant or part thereof other than a *Brassica napus* or part thereof. In an embodiment, at least one of the exogenous polynucleotides in the plant or part thereof is expressed from a promoter which is not a constitutive promoter such as, for example, a promoter which is expressed preferentially in green tissues or stems of the plant or that is up-regulated after commencement of flowering or during senescence.

In an embodiment, the exogenous polynucleotide encoding WRI1 comprises one or more of the following:
  i) nucleotides encoding a polypeptide comprising amino acids whose sequence is set forth as any one of SEQ ID NOs:21 to 75 or 196 to 201, or a biologically active fragment thereof, or a polypeptide whose amino acid sequence is at least 30% identical to any one or more of SEQ ID NOs: 21 to 75 or 196 to 201,
  ii) nucleotides whose sequence is at least 30% identical to i), and
  iii) nucleotides which hybridize to i) and/or ii) under stringent conditions. Preferably, the WRI1 polypeptide is a WRI1 polypeptide other than *Arabidopsis thaliana* WRI1 (SEQ ID NOs:21 or 22). More preferably, the WRI1 polypeptide comprises amino acids whose sequence is set forth as SEQ ID NO:199, or a biologically active fragment thereof, or a polypeptide whose amino acid sequence is at least 30% identical thereto.

In an embodiment, the part is a vegetative part and one or more or all of the promoters are expressed at a higher level in the vegetative part relative to seed of the plant.

In a further embodiment, the plant or part thereof has one or more or all of;
  i) the plant, or a part thereof, comprises a total non-polar lipid content of at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), preferably before flowering,
  ii) a vegetative part of a plant comprises a TAG content of at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), preferably before flowering, iii) one or more or all of the promoters are selected from a tissue-specific promoter such as a leaf and/or stem specific promoter, a developmentally regulated promoter such as a senescence-specific promoter such as a SAG12 promoter, an inducible promoter, or a circadian-rhythm regulated promoter, iv) the plant, or part thereof, is one member of a population or collection of at least about 1,500, at least about 3,000 or at least about 5,000 such plants, or parts thereof, preferably vegetative plant parts, wherein the first and second exogenous polynucleotides are inserted at the same chromosomal location in the genome of each of the plants, v) the plant is a member of the family Fabaceae (or Leguminosae) such as alfalfa, clover, peas, lucerne, beans, lentils, lupins, mesquite, carob, soybeans, and peanuts, or a member of the family Poaceae such as corn or *sorghum*, and vi) the part is a leaf or leaves which are mature.

In an embodiment, before the plant flowers, a vegetative part of the plant comprises a total non-polar lipid content of at least about 8%, at least about 10%, about 11%, between 8% and 15%, or between 9% and 12% (w/w dry weight).

In a further embodiment, the plant or part thereof is;
i) a 16:3 plant or a vegetative part or seed thereof, and which comprises one or more or all of the following:
   a) an exogenous polynucleotide which encodes a polypeptide which increases the export of fatty acids out of plastids of the plant when compared to a corresponding plant lacking the exogenous polynucleotide,
   b) a first genetic modification which down-regulates endogenous production and/or activity of a polypeptide involved in importing fatty acids into plastids of the plant when compared to a corresponding plant lacking the first genetic modification, and
   c) a second genetic modification which down-regulates endogenous production and/or activity of a polypeptide involved in diacylglycerol (DAG) production in the plastid when compared to a corresponding plant lacking the second genetic modification,
wherein the exogenous polynucleotide is operably linked to a promoter which is capable of directing expression of the polynucleotide in the plant, or part thereof, or
ii) a 18:3 plant or a vegetative part or seed thereof.

In an embodiment, the plant or part thereof has one or more or all of;
i) the plant comprises a part, preferably a vegetative part, which has an increased synthesis of total fatty acids relative to a corresponding part lacking the first exogenous polynucleotide, or a decreased catabolism of total fatty acids relative to a corresponding part lacking the first exogenous polynucleotide, or both, such that it has an increased level of total fatty acids relative to a corresponding part lacking the first exogenous polynucleotide, ii) the plant comprises a part, preferably a vegetative part, which has an increased expression and/or activity of a fatty acyl acyltransferase which catalyses the synthesis of TAG, DAG or MAG, preferably TAG, relative to a corresponding part having the first exogenous polynucleotide and lacking the exogenous polynucleotide which encodes a polypeptide involved in the biosynthesis of one or more non-polar lipids, iii) the plant comprises a part, preferably a vegetative part, which has a decreased production of lysophosphatidic acid (LPA) from acyl-ACP and G3P in its plastids relative to a corresponding part having the first exogenous polynucleotide and lacking the genetic modification which down-regulates endogenous production and/or activity of a polypeptide involved in diacylglycerol (DAG) production in plastids in the plant part, iv) the plant comprises a part, preferably a vegetative part, which has an altered ratio of C16:3 to C18:3 fatty acids in its total fatty acid content and/or its galactolipid content relative to a corresponding part lacking the exogenous polynucleotide(s) and/or genetic modification(s), preferably a decreased ratio, v) oleic acid comprises at least 20% (mol %), at least 22% (mol %), at least 30% (mol %), at least 40% (mol %), at least 50% (mol %), or at least 60% (mol %), preferably about 65% (mol %) or between 20% and about 65% of the total fatty acid content in the plant, or part thereof, vi) non-polar lipid in the plant, or part thereof preferably a vegetative part, comprises an increased level of one or more fatty acids which comprise a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, vii) non-polar lipid in the plant, or part thereof preferably a vegetative part, comprises one or more polyunsaturated fatty acids selected from eicosadienoic acid (EDA), arachidonic acid (ARA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA), or a combination of two of more thereof, viii) the part is a vegetative plant part, such as a leaf or a stem, or part thereof, ix) one or more or all of the promoters are selected from promoter other than a constitutive promoter, preferably a tissue-specific promoter such as a leaf and/or stem specific promoter, a developmentally regulated promoter such as a senescense-specific promoter such as a SAG12 promoter, an inducible promoter, or a circadian-rhythm regulated promoter, preferably wherein at least one of the promoters operably linked to an exogenous polynucleotide which encodes a transcription factor polypeptide is a promoter other than a constitutive promoter, x) the plant, or part thereof preferably a vegetative part, comprises a total fatty acid content whose oleic acid level and/or palmitic acid level is increased by at least 2% relative to a corresponding plant, or part thereof, lacking the exogenous polynucleotide(s) and/or genetic modification(s), and/or whose α-linolenic acid (ALA) level and/or linoleic acid level is decreased by at least 2% relative to a corresponding plant, or part thereof, lacking the exogenous polynucleotide(s) and/or genetic modification(s), xi) non-polar lipid in the plant, or part thereof preferably a vegetative part, comprises a modified level of total sterols, preferably free (non-esterified) sterols, steroyl esters, steroyl glycosides, relative to the non-polar lipid in a corresponding plant, or part thereof, lacking the exogenous polynucleotide(s) and/or genetic modification(s), xii) non-polar lipid in the plant, or part thereof, comprises waxes and/or wax esters, xiii) the plant comprises an exogenous polynucleotide encoding a silencing suppressor, wherein the exogenous polynucleotide is operably linked to a promoter which is capable of directing expression of the polynucleotide in the plant, xiv) the level of one or more non-polar lipid(s) and/or the total non-polar lipid content of the plant or part thereof, preferably a vegetative plant part, is at least 2% greater on a weight basis than in a corresponding plant or part, respectively, which comprises exogenous polynucleotides encoding an Arabidposis *thaliana* WRI1 (SEQ ID NO:21) and an *Arabidopsis thaliana* DGAT1 (SEQ ID NO:1), xv) a total polyunsaturated fatty acid (PUFA) content which is decreased relative to the total PUFA content of a corresponding plant lacking the exogenous polynucleotide(s) and/or genetic modification(s), xvi) the plant part is a potato (*Solanum tuberosum*) tuber, a sugarbeet (*Beta vulgaris*) beet, a sugarcane (*Saccharum* sp.) or sorghum (*Sorghum bicolor*) stem, a monocotyledonous plant seed having an increased total fatty acid content in its endosperm such as, for example, a wheat (*Triticum aestivum*) grain or a corn (*Zea mays*) kernel, a *Nicotiana* spp. leaf, or a legume seed having an increased total fatty acid content such as, for example, a *Brassica* sp. seed or a soybean (*Glycine max*) seed, xvii) if the plant part is a seed, the seed germinates at a rate substantially the same as for a corresponding wild-type seed or when sown in soil produces a plant whose seed germinate at a rate substantially the same as for corresponding wild-type seed, and xviii) the plant is an algal plant such as from diatoms (bacillariophytes), green algae (chlorophytes), blue-green algae (cyanophytes), golden-brown algae (chrysophytes), haptophytes, brown algae or heterokont algae.

In an embodiment, the plant or part thereof, comprises a first exogenous polynucleotide encoding a WRI1, a second exogenous polynucleotide encoding a DGAT or a PDAT, preferably a DGAT1, a third exogenous polynucleotide encoding an RNA which reduces expression of a gene encoding an SDP1 polypeptide, and a fourth exogenous polynucleotide encoding an oleosin. In preferred embodiments, the plant or part thereof has one or more or all of the following features:

i) a total lipid content of at least 8%, at least 10%, at least 12%, at least 14%, or at least 15.5% (% dry weight), ii) at least a 3 fold, at least a 5 fold, at least a 7 fold, at least an 8 fold, or least a 10 fold, higher total lipid content in the the plant or part thereof relative to a corresponding the plant or part thereof lacking the exogenous polynucleotides and genetic modifications, iii) a total TAG content of at least 5%, at least 6%, at least 6.5% or at least 7% (% weight of dry weight or seed weight), iv) at least a 40 fold, at least a 50 fold, at least a 60 fold, or at least 70 fold, at least 100 fold, or at least a 120-fold higher total TAG content relative to a corresponding the plant or part thereof lacking the exogenous polynucleotides and genetic modifications, v) oleic acid comprises at least 15%, at least 19% or at least 22% (% weight of dry weight or seed weight) of the fatty acids in TAG, vi) at least a 10 fold, at least a 15 fold or at least a 17 fold higher level of oleic acid in TAG relative to a corresponding the plant or part thereof lacking the exogenous polynucleotides and genetic modifications, vii) palmitic acid comprises at least 20%, at least 25%, at least 30% or at least 33% (% weight) of the fatty acids in TAG, viii) at least a 1.5 fold higher level of palmitic acid in TAG relative to a corresponding the plant or part thereof lacking the exogenous polynucleotides and genetic modifications, ix) linoleic acid comprises at least 22%, at least 25%, at least 30% or at least 34% (% weight) of the fatty acids in TAG, x) α-linolenic acid comprises less than 20%, less than 15%, less than 11% or less than 8% (% weight) of the fatty acids in TAG, xi) at least a 5 fold, or at least an 8 fold, lower level of α-linolenic acid in TAG relative to a corresponding plant or part thereof lacking the exogenous polynucleotides and genetic modifications, and xii) when the part is a potato tuber, a TAG content of at least 0.5% on a dry weight basis and/or a total fatty acid content of at least 1%, preferably at least 1.5% or at least 2.0%, on a dry weight basis.

In the above embodiments, a preferred plant part is a leaf piece having a surface area of at least 1 cm$^2$ or a stem piece having a length of at least 1 cm.

In an embodiment of the above aspects, the plant or plant part of the invention has been treated so it is no longer able to be propagated or give rise to a living plant, i.e. it is dead, for example a brown leaf or stem. For example, the plant or plant part has been dried and/or ground. In another embodiment, the plant part is alive, for example, a green leaf or stem.

In an embodiment, the part is a seed, fruit, or a vegetative part such as an aerial plant part or a green part such as a leaf or stem.

In the above embodiments, it is preferred that the part is a vegetative part from a plant which is growing in soil or which was grown in soil and the plant part was subsequently harvested, and wherein the vegetative part comprises at least 8% TAG on a weight basis (% dry weight) such as for example between 8% and 75% or between 8% and 30%. More preferably, the TAG content is at least 10%, such as for example between 10% and 75% or between 10% and 30%. Preferably, these TAG levels are present in the vegetative parts prior to or at flowering of the plant or prior to seed setting stage of plant development. In these embodiments, it is preferred that the ratio of the TAG content in the leaves to the TAG content in the stems of the plant is between 1:1 and 10:1, and/or the ratio is increased relative to a corresponding vegetative part comprising the first and second exogenous polynucleotides and lacking the first genetic modification. Preferably, the vegetative plant part has an increased soluble protein content relative to the corresponding wild-type vegetative part of at least about 100%, or between about 50% and about 125%. Preferably, the vegetative plant part has an increased nitrogen content relative to the corresponding wild-type vegetative part of at least about 100%, or between about 50% and about 125%. Preferably, the vegetative plant part has an decreased carbon:nitrogen content relative to the corresponding wild-type vegetative plant part of at least about 40%, or between about 25% and about 50%. Preferably, the vegetative plant part has a decreased TDF content relative to the corresponding wild-type vegetative plant part of at least about 30%, or between about 30% and about 65%.

In an embodiment, the plant of the invention is a monocotyledonous plant, or part thereof preferably a leaf, a grain, a stem, a root or an endosperm, which has a total fatty acid content or TAG content which is increased at least 5-fold on a weight basis when compared to a corresponding wild-type monocotyledonous plant, or part thereof. Alternatively, the monocotyledonous plant has endosperm comprising a TAG content which is at least 2.0%, preferably at least 3%, more preferably at least 4% or at least 5%, on a weight basis, or part of the plant, preferably a leaf, a stem, a root, a grain or an endosperm. In an embodiment, the endosperm has a TAG content of at least 2% which is increased at least 5-fold relative to a corresponding wild-type endosperm. Preferably, the plant is fully male and female fertile, its pollen is essentially 100% viable, and its grain has a germination rate which is between 70% and 100% relative to corresponding wild-type grain. In an embodiment, the transgenic plant of the invention is a progeny plant at least two generations derived from an initial transgenic plant, and is preferably homozygous for the transgenes. In embodiments, the monocotyledonous plant, or part thereof preferably a leaf, stem, grain or endosperm, is further characterised by one or more features as described in the context of a plant or part thereof of the invention. In embodiments, the monocotyledonous plant, or part thereof preferably a leaf, a grain, stem or an endosperm of the invention preferably has an increased level of monounsaturated fatty acids (MUFA) and/or a lower level of polyunsaturated fatty acids (PUFA) in both the total fatty acid content and in the TAG fraction of the total fatty acid content, such as for example an increased level of oleic acid and a decreased level of LA (18:2), when compared to a corresponding plant or part thereof lacking the genetic modifications and/or exogenous polynucleotide(s). Preferably, the linoleic acid (LA, 18:2) level in the total fatty acid content of the grain or endosperm of the the monocotyledonous plant is decreased by at least 5% and/or the level of oleic acid in the total fatty acid content is increased by at least 5% relative to a corresponding wild-type plant or part thereof, preferably at least 10% or more preferably at least 15%, when compared to a corresponding plant or part thereof lacking the genetic modifications and/or exogenous polynucleotide(s).

In an embodiment, the plant or part thereof is *Acrocomia aculeata* (macauba palm), *Arabidopsis thaliana*, *Aracinis hypogaea* (peanut), *Astrocaryum murumuru* (murumuru), *Astrocaryum vulgare* (tucumã), *Attalea geraensis* (Indaiá-rateiro), *Attalea humilis* (American oil palm), *Attalea oleifera* (andaiá), *Attalea phalerata* (uricuri), *Attalea speciosa* (babassu), *Avena sativa* (oats), *Beta vulgaris* (sugar beet), *Brassica* sp. such as, for example, *Brassica carinata*, *Brassica juncea*, *Brassica napobrassica*, *Brassica napus* (canola), *Camelina sativa* (false flax), *Cannabis sativa* (hemp), *Carthamus tinctorius* (safflower), *Caryocar brasiliense* (pequi), *Cocos nucifera* (Coconut), *Crambe abyssinica* (Abyssinian kale), *Cucumis melo* (melon), *Elaeis guineensis* (African palm), *Glycine max* (soybean), *Gossypium hirsutum* (cotton), *Helianthus* sp. such as *Helianthus annuus* (sunflower), *Hordeum vulgare* (barley), *Jatropha curcas* (physic nut), *Joannesia princeps* (arara nut-tree), *Lemna* sp. (duckweed) such as *Lemna aequinoctialis*, *Lemna disperma*, *Lemna ecuadoriensis*, *Lemna gibba* (swollen duckweed), *Lemna japonica*, *Lemna minor*, *Lemna minuta*, *Lemna obscura*, *Lemna paucicostata*, *Lemna perpusilla*, *Lemna tenera*, *Lemna trisulca*, *Lemna turionifera*, *Lemna valdiviana*, *Lemna yungensis*, *Licania rigida* (oiticica), *Linum usitatissimum* (flax), *Lupinus angustifolius* (lupin), *Mauritia flexuosa* (buriti palm), *Maximiliana maripa* (inaja palm), *Miscanthus* sp. such as *Miscanthus* x *giganteus* and *Miscanthus sinensis*, *Nicotiana* sp. (tabacco) such as *Nicotiana tabacum* or *Nicotiana benthamiana*, *Oenocarpus bacaba* (bacaba-do-azeite), *Oenocarpus bataua* (patauã), *Oenocarpus distichus* (bacaba-de-leque), *Oryza* sp. (rice) such as *Oryza sativa* and *Oryza glaberrima*, *Panicum virgatum* (switchgrass), *Paraqueiba paraensis* (mari), *Persea amencana* (avocado), *Pongamia pinnata* (Indian beech), *Populus trichocarpa*, *Ricinus communis* (castor), *Saccharum* sp. (sugarcane), *Sesamum indicum* (sesame), *Solanum tuberosum* (potato), *Sorghum* sp. such as *Sorghum bicolor*, *Sorghum vulgare*, *Theobroma grandiforum* (cupuassu), *Trifolium* sp., *Trithrinax brasiliensis* (Brazilian needle palm), *Triticum* sp. (wheat) such as *Triticum aestivum* and *Zea mays* (corn).

In an embodiment, the plant, or part thereof, is a member of a population or collection of at least about 1,500, at least about 3,000 or at least about 5,000 such plants or parts.

In an embodiment, the TFA content, the the TAG content, the total non-polar lipid content, or the one or more non-polar lipids, and/or the level of the oleic acid or a PUFA in the plant or part thereof is determinable by analysis by using gas chromatography of fatty acid methyl esters obtained from the plant or vegetative part thereof.

In a further embodiment, the plant part is a leaf and the total non-polar lipid content of the leaf is determinable by analysis using Nuclear Magnetic Resonance (NMR).

In each of the above embodiments, it is preferred that the plant is a transgenic progeny plant at least two generations derived from an initial transgenic plant, and is preferably homozygous for the transgenes.

In an embodiment, the plant or the part thereof of the invention is phenotypically normal, in that it is not significantly reduced in its ability to grow and reproduce when compared to an unmodified plant or part thereof. In an embodiment, the biomass, growth rate, germination rate, storage organ size, seed size and/or the number of viable seeds produced is not less than 70%, not less than 80% or not less than 90% of that of a corresponding wild-type plant when grown under identical conditions. In an embodiment, the plant is male and female fertile to the same extent as a corresponding wild-type plant and its pollen (if produced) is as viable as the pollen of the corresponding wild-type plant, preferably at least about 75%, or at least about 90%, or close to 100% viable. In an embodiment, the plant produces seed which has a germination rate of at least about 75% or at least about 90% relative to the germination rate of corresponding seed of a wild-type plant, where the plant species produces seed. In an embodiment, the plant of the invention has a plant height which is at least about 75%, or at least about 80% or at least about 90% relative to the height of the corresponding wild-type plant grown under the same conditions. A combination of each of these features is envisaged. In an alternative embodiment, the plant of the invention has a plant height which is between 60% and 90% relative to the height of the corresponding wild-type plant grown under the same conditions. In an embodiment, the plant or part thereof of the invention, preferably a plant leaf, does not exhibit increased necrosis, i.e. the extent of necrosis, if present, is the same as that exhibited by a corresponding wild-type plant or part thereof grown under the same conditions and at the same stage of plant development. This feature applies in particular to the plant or part thereof comprising an exogenous polynucleotide which encodes a fatty acid thioesterase such as a FATB thioesterase.

In a further aspect, the present invention provides a collection of at least about 1,500, at least about 3,000 or at least about 5,000 vegetative plant parts, each being a vegetative plant part of the invention, wherein the vegetative plant parts have been harvested from plants growing in a field.

In an embodiment, the first and second exogenous polynucleotides are inserted at the same chromosomal location in the genome of each of the vegetative plant parts, preferably in the nuclear genome of each of the vegetative plant parts.

Also provided is a storage bin comprising a collection of vegetative plant parts of the invention.

Further provided is seed of, or obtained from, a plant of the invention, preferably a collection of at least about 1,500, at least about 3,000 at least about 5,000, or at least about 10,000 seeds of the invention, comprising the exogenous polynucleotides.

In another aspect, the present invention provides an extract of a plant or a part thereof of the invention. The extract preferably has a different fatty acid composition relative to a corresponding wild-type extract.

In an embodiment, the extract comprises the first and second exogenous polynucleotides.

In an embodiment, the extract is lacking at least 50% or at least 90% of the non-polar lipids of the plant or part thereof.

In an embodiment, the extract comprises the soluble protein content of the plant or part thereof.

In an embodiment, the extract comprises the nitrogen content of the plant or part thereof.

In an embodiment, the extract is lacking at least 50% or at least 90% of the chlorophyll and/or soluble sugars of the plant or part thereof.

In an embodiment, the extract comprises the carbon content of the plant or part thereof.

In an embodiment, the extract comprises a dye which binds protein in the extract.

Extracts of the invention can readily be produced using standard techniques in the art.

Combinations of the features of the above aspects are clearly contemplated for the plant, plant part and cell of the invention, and in the processes of producing and using them.

In another aspect, the present invention provides a method of producing a plant extract, the method comprising
  i) obtaining a plant or part thereof of the invention, or seed of the invention, and
  ii) processing the plant or part thereof, or seed, to produce the extract.

In an embodiment, the plant or part thereof of the invention, or seed of the invention, is transgenic.

In an embodiment, step ii) comprising producing two or more fractions from the plant or part thereof, or seed, and selecting at least one, but not all of the fractions.

In an embodiment, the selected fraction(s) has one or more of the following features;
  i) comprises the first and second exogenous polynucleotides,
  ii) is lacking at least 50% or at least 90% of the non-polar lipids of the plant or part thereof,
  iii) comprises the soluble protein content of the plant or part thereof,
  iv) comprises the nitrogen content of the plant or part thereof,
  v) is lacking at least 50% or at least 90% of the chlorophyll and/or soluble sugars of the plant or part thereof, and
  vi) comprises the carbon content of the plant or part thereof.

In a further aspect, the present invention provides a process for selecting a plant or a part thereof with a desired phenotype, the process comprising
  i) obtaining a plurality of candidate plants, or parts thereof, which each comprise
    a) a first exogenous polynucleotide which encodes a transcription factor polypeptide that increases the expression of one or more glycolytic and/or fatty acid biosynthetic genes in a plant or part thereof, and
    b) a second exogenous polynucleotide which encodes a polypeptide involved in the biosynthesis of one or more non-polar lipids,
  wherein each exogenous polynucleotide is operably linked to a promoter which is capable of directing expression of the polynucleotide in the plant, or part thereof,
  ii) analysing lipid in the plurality of parts, or at least a part of each plant in the plurality of candidate plants, from step i),
  iii) analysing the plurality of parts, or at least a part of each plant in the plurality of candidate plants, from step i) for one or more or all of;
    a) soluble protein content,
    b) nitrogen content,
    c) carbon:nitrogen ratio,
    d) photosynthetic gene expression,
    e) photosynthetic capacity,
    f) total dietary fibre (TDF) content,
    g) carbon content,
    h) energy content,
    i) TAG content, and
    j) TTQ, and
  iv) selecting a plant or part thereof which comprises an increased TTQ and/or an increased triacylglycerol (TAG) content in the part or at least a part of the plant relative to a corresponding wild-type plant or part thereof and a desired phenotype selected from one or more or all of the following;
    A) an increased soluble protein content in the part or at least a part of the plant relative to a corresponding wild-type plant or part thereof,
    B) an increased nitrogen content in the part or at least a part of the plant relative to a corresponding wild-type plant or part thereof,
    C) decreased carbon:nitrogen ratio in the part or at least a part of the plant relative to a corresponding wild-type plant or part thereof,
    D) increased photosynthetic gene expression in the part or at least a part of the plant relative to a corresponding wild-type plant or part thereof,
    E) increased photosynthetic capacity in the part or at least a part of the plant relative to a corresponding wild-type plant or part thereof,
    F) decreased total dietary fibre (TDF) content in the part or at least a part of the plant relative to a corresponding wild-type plant or part thereof,
    G) increased carbon content in the part or at least a part of the plant relative to a corresponding wild-type plant or part thereof, and
    H) increased energy content in the part or at least a part of the plant relative to a corresponding wild-type plant or part thereof.

In an embodiment, the increased triacylglycerol (TAG) content is determined by analysing one or more of the total fatty acid content, TAG content, fatty acid composition, by any means, which might or might not involve first extracting the lipid.

In yet another embodiment, the selected plant or part thereof has one or more of the features as described herein.

In another aspect, the present invention provides a process for producing a feedstuff, the process comprising admixing a plant or part thereof of any one of the invention, seed of the invention, or an extract of the invention, with at least one other food ingredient.

In another aspect, the present invention provides a feedstuff comprising a cell of the invention, plant or part thereof of the invention, seed of the invention, extracted oil or an extract of the invention.

In an embodiment, the feedstuff is silage, pellets or hay.

In yet a further aspect, the present invention provides a process for feeding an animal, the process comprising providing to the animal a cell of the invention, plant or part thereof of the invention, seed of the invention, extracted lipid or other extract of the invention, or a feedstuff of the invention. In an embodiment, the material provided to the animal is the residue plant material remaining after at least some of the oil has been extracted, such as seedmeal or leaf/stem meal.

In an embodiment, the animal ingests an increased amount of nitrogen, protein, carbon and/or energy potential relative to when the animal ingests the same amount on a dry weight basis of a corresponding wild-type cell, plant or part thereof, seed or extract or feedstuff produced from the corresponding wild-type plant or part thereof.

The present inventors have identified a sub-class of OBC that are non-allergenic, or not known to be allergenic, such as to humans.

Thus, in a further aspect, the present invention provides a recombinant eukaryotic cell, preferably a *Sorghum* sp. or *Zea mays* cell, comprising at least a first exogenous polynucleotide which encodes a non-allergenic OBC, wherein the exogenous polynucleotide is operably linked to a promoter which is capable of directing expression of the polynucleotide in the cell.

In an embodiment, the first exogenous polynucleotide comprises one or more of the following:
  i) nucleotides encoding an OBC polypeptide comprising amino acids whose sequence is set forth as any one of SEQ ID NOs: 306 to 314, or a biologically active fragment thereof, or an OBC polypeptide whose amino acid sequence is at least 30% identical to any one or more of SEQ ID NOs: 306 to 314, wherein the OBC polypeptide is non-allergenic,
  ii) nucleotides whose sequence is at least 30% identical to i), and
  iii) a polynucleotide which hybridizes to one or both of i) or ii) under stringent conditions. In an embodiment, the oleosinL is not sesame oleosinL (SEQ ID NO:305).

In an embodiment, the recombinant cell comprises one or more of the following:
  a) a second exogenous polynucleotide which encodes a transcription factor polypeptide that increases the expression of one or more glycolytic and/or fatty acid biosynthetic genes in the cell, preferably a WRI1 polypeptide,
  b) a third exogenous polynucleotide which encodes a polypeptide involved in the biosynthesis of one or more non-polar lipids, preferably a DGAT and/or a PDAT,
  c) a first genetic modification which down-regulates endogenous production and/or activity of a polypeptide involved in the catabolism of triacylglycerols (TAG) in the cell, preferably an SDP1 TAG lipase, when compared to a corresponding cell lacking the genetic modification,
  d) a fourth exogenous polynucleotide which encodes a polypeptide which increases the export of fatty acids out of plastids of the cell when compared to a corresponding cell lacking the exogenous polynucleotide, preferably an acyl-ACP thioesterase polypeptide,
  e) a fifth exogenous polynucleotide which encodes a second transcription factor polypeptide that increases the expression of one or more glycolytic and/or fatty acid biosynthetic genes in the cell, preferably a LEC2 polypeptide,
  f) a second genetic modification which down-regulates endogenous production and/or activity of a polypeptide involved in importing fatty acids into plastids of the cell, preferably a TGD polypeptide, when compared to a corresponding cell lacking the genetic modification,
  g) a sixth exogenous polynucleotide which encodes a lipid droplet associated protein (LDAP),
  h) a third genetic modification which down-regulates endogenous production and/or activity of a polypeptide involved in diacylglycerol (DAG) production in the plastid when compared to a corresponding cell lacking the genetic modification, and
  i) a fourth genetic modification which down-regulates endogenous production and/or activity of a polypeptide involved in importing fatty acids into plastids of the cell when compared to a corresponding cell lacking the genetic modification,
wherein each exogenous polynucleotide is operably linked to a promoter which is capable of directing expression of the polynucleotide in the cell.

In an embodiment, the cell is a plant cell from or in a vegetative part of a plant and one or more or all of the promoters are expressed at a higher level in the vegetative part relative to seed of the plant.

In an embodiment, the first exogenous polynucleotide is codon optimised for expression in a plant cell such as a *Sorghum* sp. or *Zea mays* cell.

In an embodiment, one or more or all of the following features apply to the above aspects:
  i) the cell has an increased synthesis of total fatty acids relative to a corresponding cell lacking the second exogenous polynucleotide, or a decreased catabolism of total fatty acids relative to a corresponding cell lacking the second exogenous polynucleotide, or both, such that it has an increased level of total fatty acids relative to a corresponding cell lacking the second exogenous polynucleotide,
  ii) the cell has an increased expression and/or activity of a fatty acyl acyltransferase which catalyses the synthesis of TAG, DAG or MAG, preferably TAG, relative to a corresponding cell having the second exogenous polynucleotide and lacking the third exogenous polynucleotide which encodes a polypeptide involved in the biosynthesis of one or more non-polar lipids,
  iii) the cell has a decreased production of lysophosphatidic acid (LPA) from acyl-ACP and G3P in its plastids relative to a corresponding cell having the second exogenous polynucleotide and lacking the third genetic modification which down-regulates endogenous production and/or activity of a polypeptide involved in diacylglycerol (DAG) production in the plastid in the cell, iv) the cell has an altered ratio of C16:3 to C18:3 fatty acids in its total fatty acid content and/or its galactolipid content relative to a corresponding cell lacking the exogenous polynucleotide(s) and/or genetic modification(s), preferably a decreased ratio, v) the cell is in a vegetative part of a plant and comprises a total non-polar lipid content of at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), vi) the cell is in a vegetative part of a plant and comprises a TAG content of at least about 8%, at least about 10%, at least about 11%, at least about 12%, at least about 15%, at least about 20%, at least about 25%, at least about 30%, at least about 35%, at least about 40%, at least about 45%, at least about 50%, at least about 55%, at least about 60%, at least about 65%, at least about 70%, between 8% and 75%, between 10% and 75%, between 11% and 75%, between about 15% and 75%, between about 20% and 75%, between about 30% and 75%, between about 40% and 75%, between about 50% and 75%, between about 60% and 75%, or between about 25% and 50% (w/w dry weight), vii) the transcription factor polypeptide is selected from the group consisting of Wrinkled 1 (WRI1), Leafy Cotyledon 1 (LEC1), LEC1-like, Leafy Cotyledon 2 (LEC2), BABY BOOM (BBM), FUS3, ABI3, ABI4, ABI5, Dof4 and Dof11, viii) oleic acid comprises at least 20% (mol %), at least 22% (mol %), at least 30% (mol %), at least 40% (mol %), at least 50% (mol %), or at least 60% (mol %), preferably about 65% (mol %) or between 20% and about 65% of the total fatty acid content in the cell, ix) non-polar lipid in the cell comprises a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, x) non-polar lipid in the cell comprises one or more polyunsaturated fatty acids selected from eicosadienoic acid (EDA), arachidonic acid (ARA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA), or a combination of two of more thereof, xi) the cell is in a plant or part thereof, preferably a vegetative plant part, or the cell is an algal cell such as a diatom (bacillariophytes), green algae (chlorophytes), blue-green algae (cyanophytes), golden-brown algae (chrysophytes), haptophytes, brown algae or heterokont algae, or the cell is from or is an organism suitable for fermentation such as a fungus, xii) one or more or all of the promoters are selected from a tissue-specific promoter such as a leaf and/or stem specific promoter, a developmentally regulated promoter such as a senescense-specific promoter such as a SAG12 promoter, an inducible promoter, or a circadian-rhythm regulated promoter, xiii) the cell comprises a total fatty acid content which comprises medium chain fatty acids, preferably C12:0, C14:0 or both, at a level of at least 5% of the total fatty acid content and optionally an exogenous polynucleotide which encodes an LPAAT which has preferential activity for fatty acids with a medium chain length (C8 to C14), preferably C12:0 or C14:0, xiv) the cell comprises a total fatty acid content whose oleic acid level is increased by at least 2% relative to a corresponding cell lacking the exogenous polynucleotide(s) and/or genetic modification(s), and/or whose α-linolenic acid (ALA) level is decreased by at least 2% relative to a corresponding cell lacking the exogenous polynucleotide(s) and/or genetic modification(s), xv) non-polar lipid in the cell comprises a modified level of total sterols, preferably free (non-esterified) sterols, steroyl esters, steroyl glycosides, relative to the non-polar lipid in a corresponding cell lacking the exogenous polynucleotide(s) and/or genetic modification(s), xvi) non-polar lipid in the cell comprises waxes and/or wax esters, xvii) the cell is one member of a population or collection of at least about 1000 such cells, preferably in a vegetative plant part or a seed, xviii) the cell comprises an exogenous polynucleotide encoding a silencing suppressor, wherein the exogenous polynucleotide is operably linked to a promoter which is capable of directing expression of the polynucleotide in the cell, xix) the level of one or more non-polar lipid(s) and/or the total non-polar lipid content of the cell is at least 2% greater on a weight basis than in a corresponding cell which comprises exogenous polynucleotides encoding an Arabidposis *thaliana* WRI1 (SEQ ID NO:21) and an *Arabidopsis thaliana* DGAT1 (SEQ ID NO:1), and xx) a total polyunsaturated fatty acid (PUFA) content which is decreased relative to the total PUFA content of a corresponding cell lacking the exogenous polynucleotide(s) and/or genetic modification(s).

Any embodiment herein shall be taken to apply mutatis mutandis to any other embodiment unless specifically stated otherwise.

Combinations of the features of the above aspects are clearly contemplated for the plant, plant part and cell of the invention, and in the processes of producing and using them.

The present invention is not to be limited in scope by the specific embodiments described herein, which are intended for the purpose of exemplification only.

Functionally-equivalent products, compositions and methods are clearly within the scope of the invention, as described herein.

Throughout this specification, unless specifically stated otherwise or the context requires otherwise, reference to a single step, composition of matter, group of steps or group of compositions of matter shall be taken to encompass one and a plurality (i.e. one or more) of those steps, compositions of matter, groups of steps or group of compositions of matter.

The invention is hereinafter described by way of the following non-limiting Examples and with reference to the accompanying figures.

BRIEF DESCRIPTION OF THE ACCOMPANYING DRAWINGS

FIG. 1. A representation of lipid synthesis in eukaryotic cells, showing export of some of the fatty acids synthesized in the plastids to the Endoplasmic Reticulum (ER) via the Plastid Associated Membrane (PLAM), and import of some of the fatty acids into the plastid from the ER for eukaryotic galactolipid synthesis. Abbreviations:
Acetyl-CoA and Malonyl-CoA: acetyl-coenzyme A and malonyl-coenzymeA;
ACCase: Acetyl-CoA carboxylase;
FAS: fatty acid synthase complex;
16:0-ACP, 18:0-ACP and 18:1-ACP: C16:0-acyl carrier protein (ACP), C18:0-acyl carrier protein, C18:1-acyl carrier protein;
KAS II: ketoacyl-ACP synthase II (EC 2.3.1.41);
PLPAAT: plastidial LPAAT;
PGPAT: plastidial GPAT;
PAP: PA phosphorylase (EC 3.1.3.4);
G3P: glycerol-3-phosphate;
LPA: lysophosphatidic acid;
PA: phosphatidic acid;
DAG: diacylglycerol;
TAG: triacylglycerol;
Acyl-CoA and Acyl-PC: acyl-coenzyme A and acyl-phosphatidylcholine;
PC: phosphatidylcholine;
GPAT: glycerol-3-phosphate acyltransferase;
LPAAT: lysophosphatidic acid acyltransferase (EC 2.3.1.51);
LPCAT: acyl-CoA:lysophosphatidylcholine acyltransferase; or synonyms 1-acylglycerophosphocholine O-acyltransferase; acyl-CoA:1-acyl-sn-glycero-3-phosphocholine O-acyltransferase (EC 2.3.1.23);
CPT: CDP-choline: diacylglycerol cholinephosphotransferase; or synonyms 1-alkyl-2-acetylglycerol cholinephosphotransferase; alkylacylglycerol cholinephosphotransferase; cholinephosphotransferase; phosphorylcholine-glyceride transferase (EC 2.7.8.2);
PDCT: phosphatidylcholine:diacylglycerol cholinephosphotransferase;
PLC: phospholipase C (EC 3.1.4.3);
PLD: Phospholipase D; choline phosphatase; lecithinase D;
lipophosphodiesterase II (EC 3.1.4.4);
PDAT: phospholipid: diacylglycerol acyltransferase; or synonym phospholipid:1,2-diacyl-sn-glycerol O-acyltransferase (EC 2.3.1.158);
FAD2: fatty acid Δ12-desaturase; FAD3, fatty acid Δ15-desaturase;
UDP-Gal: Uridine diphosphate galactose;
MGDS: monogalactosyldiacylglycerol synthase;
MGDG: monogalactosyldiacylglycerol; DGDG: digalactosyldiacylglycerol
FADE, 7, 8: plastidial fatty acid Δ12-desaturase, plastidial ω3-desaturase, plastidial ω3-desaturase induced at low temperature, respectively.

Figure 2:
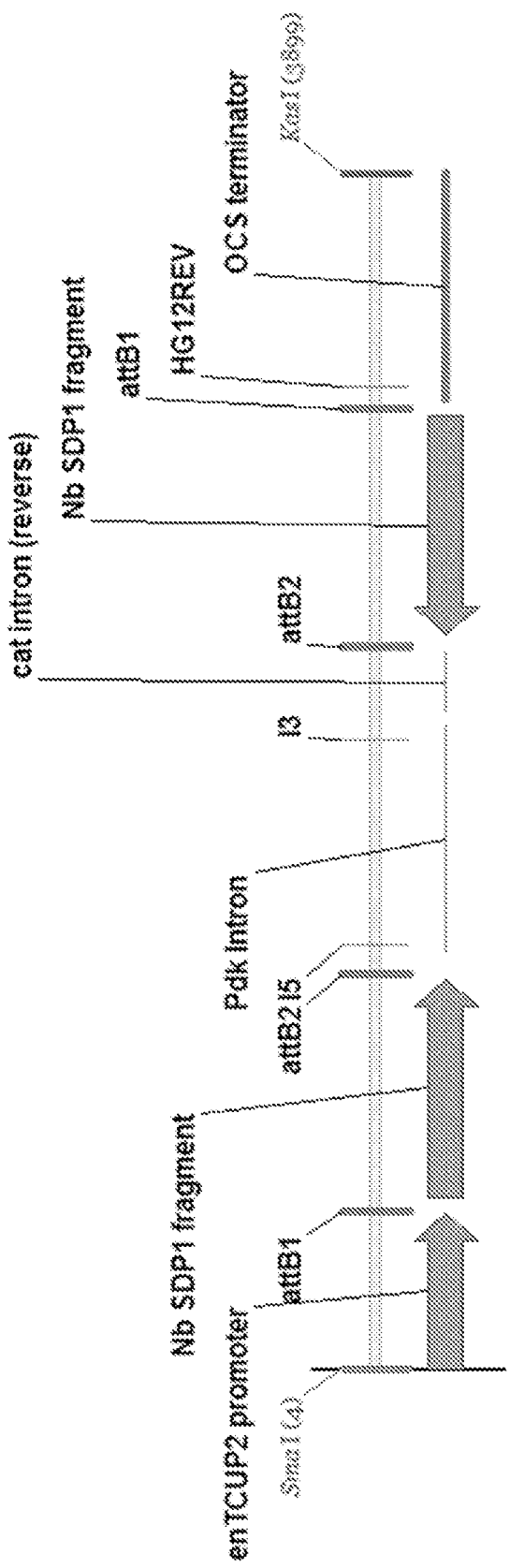

FIG. 2. Schematic representation of the *N. benthamiana* SDP1 hairpin construct. The genetic segments shown are as described in Example 2. Abbreviations are as for FIG. 12. attB sites represent recombination sites from the pHELLSGATE12 vector.

Figure 3:
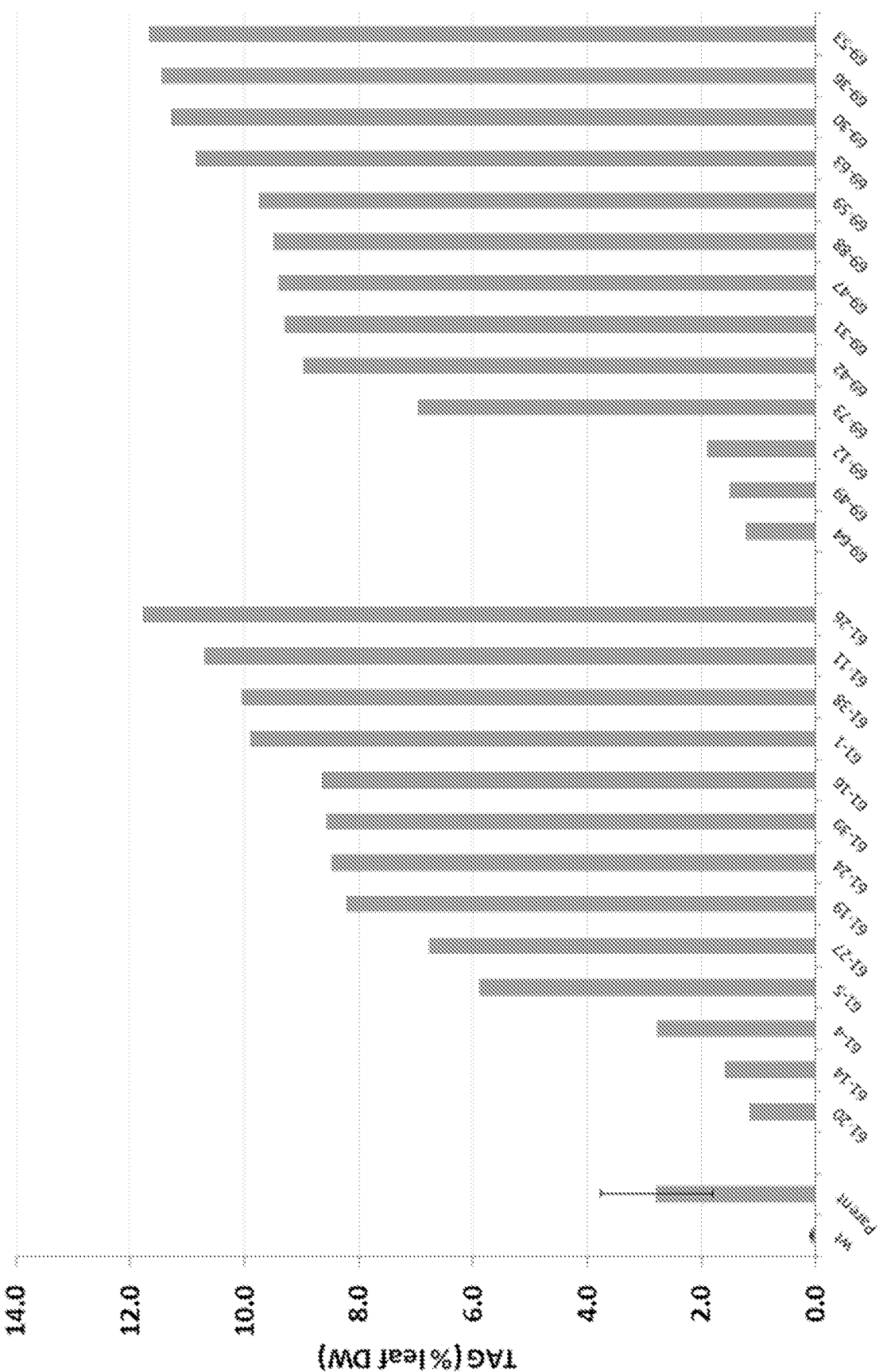

FIG. 3. TAG content in green leaf samples of tobacco plants transformed with the T-DNA from pOIL51, lines #61 and #69, harvested before flowering. The controls (parent) samples were from plants transformed with the T-DNA from pJP3502.

Figure 4:
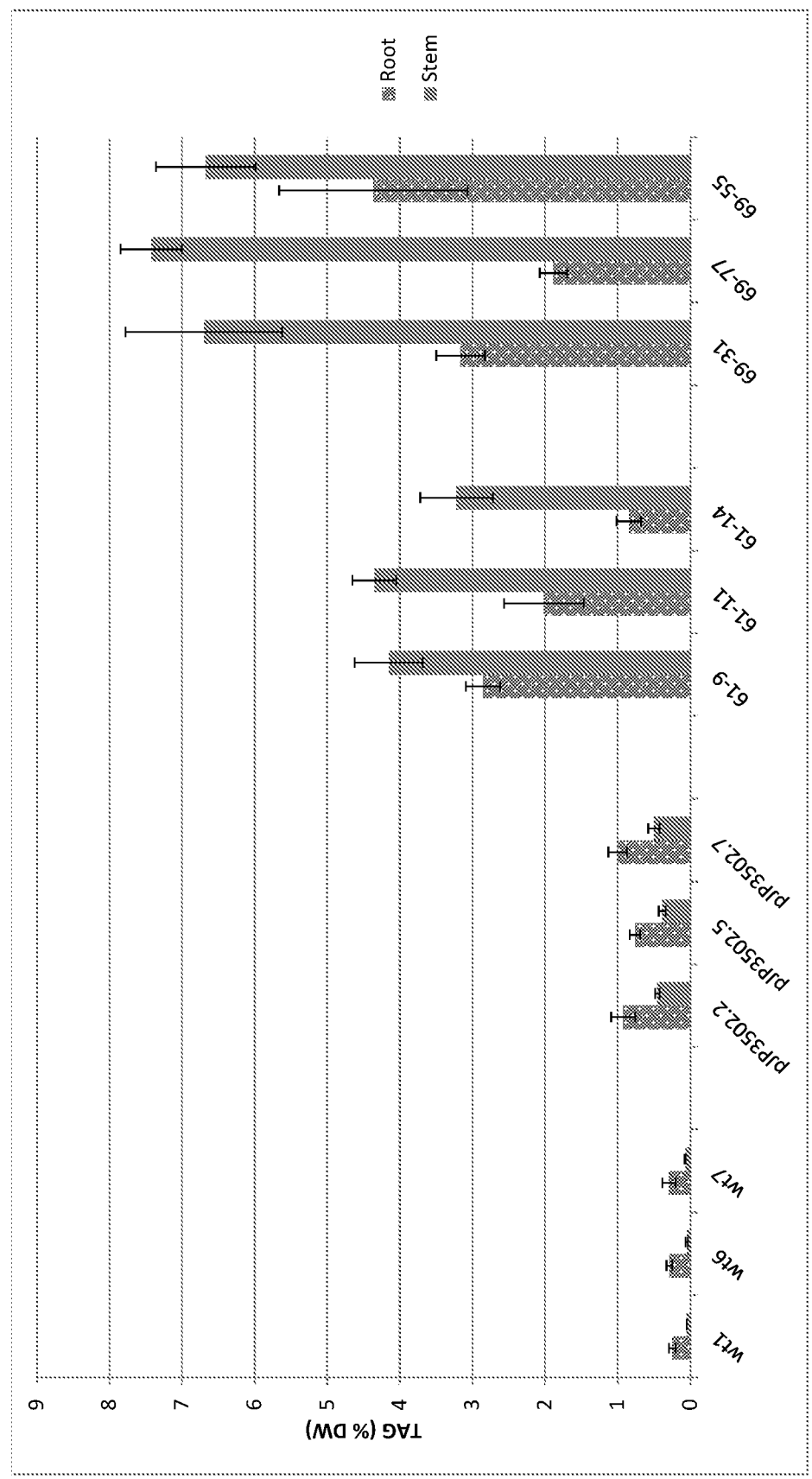

FIG. 4. TAG levels (% dry weight) in root and stem tissue of wild-type (wt) and transgenic *N. tabacum* plants containing the T-DNA from pJP3502 alone or additionally with the T-DNA from pOIL051.

Figure 5:
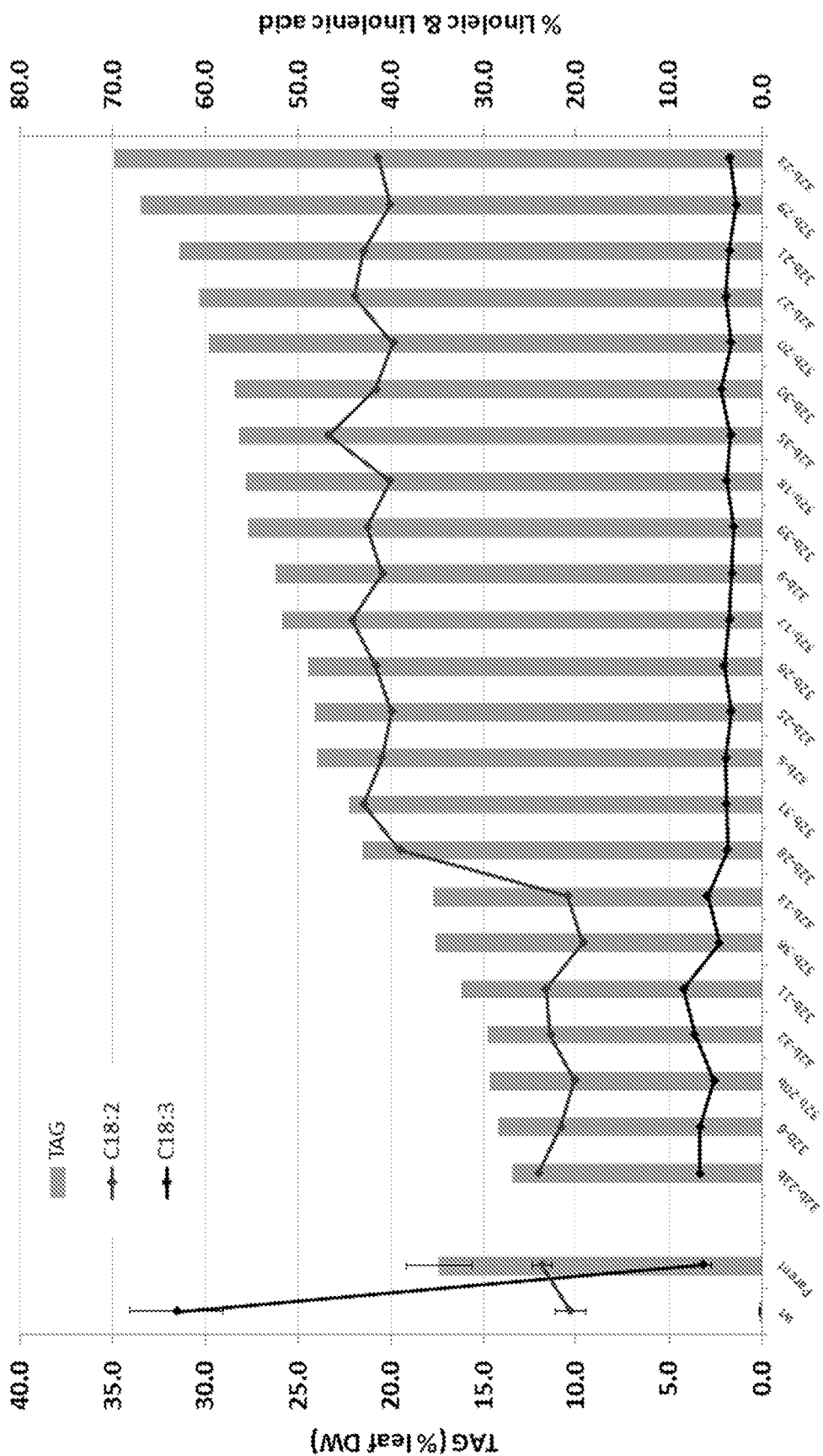

FIG. 5. TAG content in leaf samples of transformed tobacco plants at seed-setting stage of growth, transformed with the T-DNA from pOIL049, lines #23c and #32b. The controls (parent) samples were from plants transformed with the T-DNA from pJP3502. The upper line shows 18:2 percentage in the TAG and the lower line shows the 18:3 (ALA) percentage in the fatty acid content.

Figure 6:
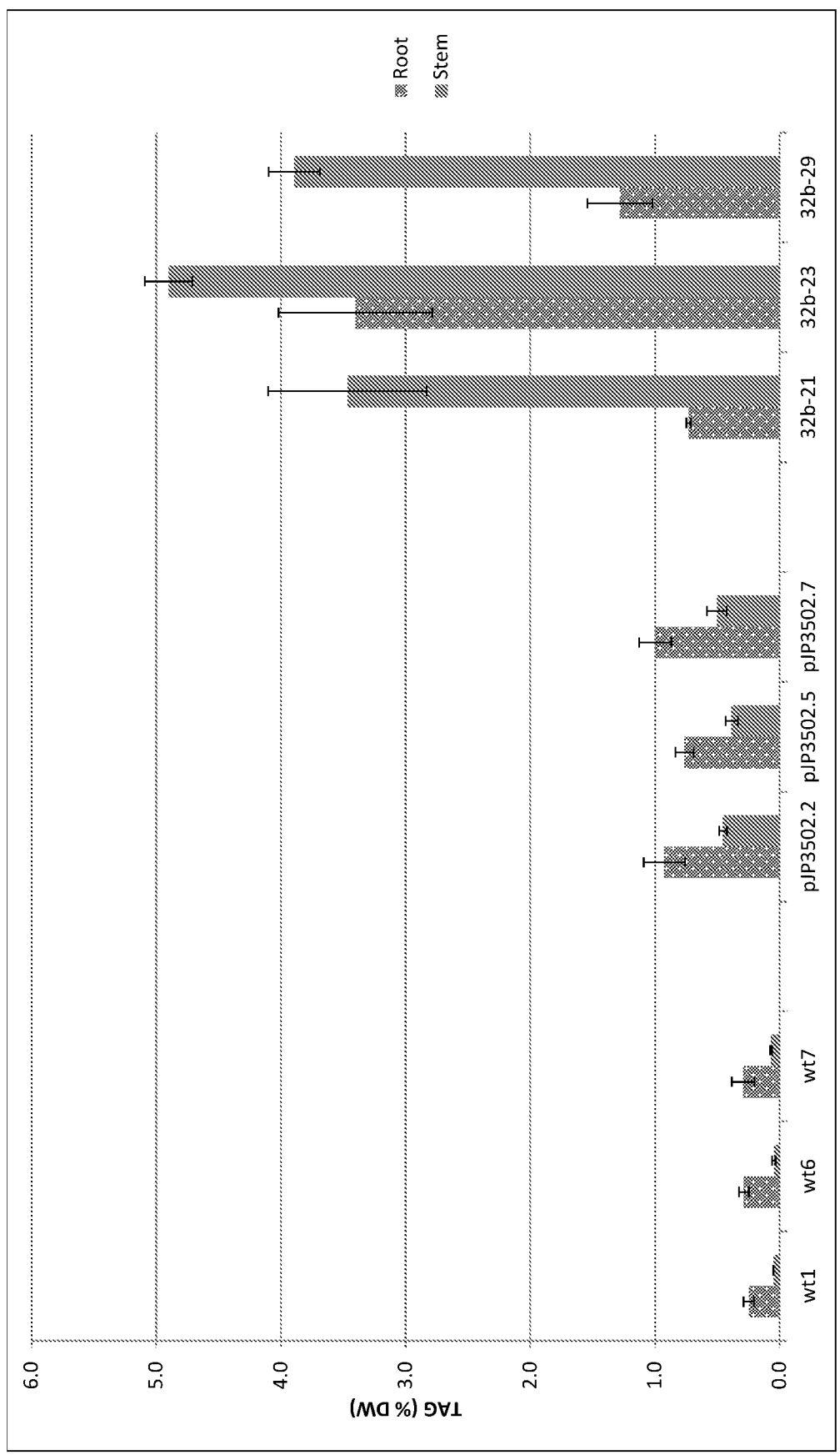

FIG. 6. TAG levels (% dry weight) in root and stem tissue of wild-type (wt) and transgenic *N. tabacum* plants containing the T-DNA from pJP3502 alone or additionally with the T-DNA from pOIL049.

Figure 7:
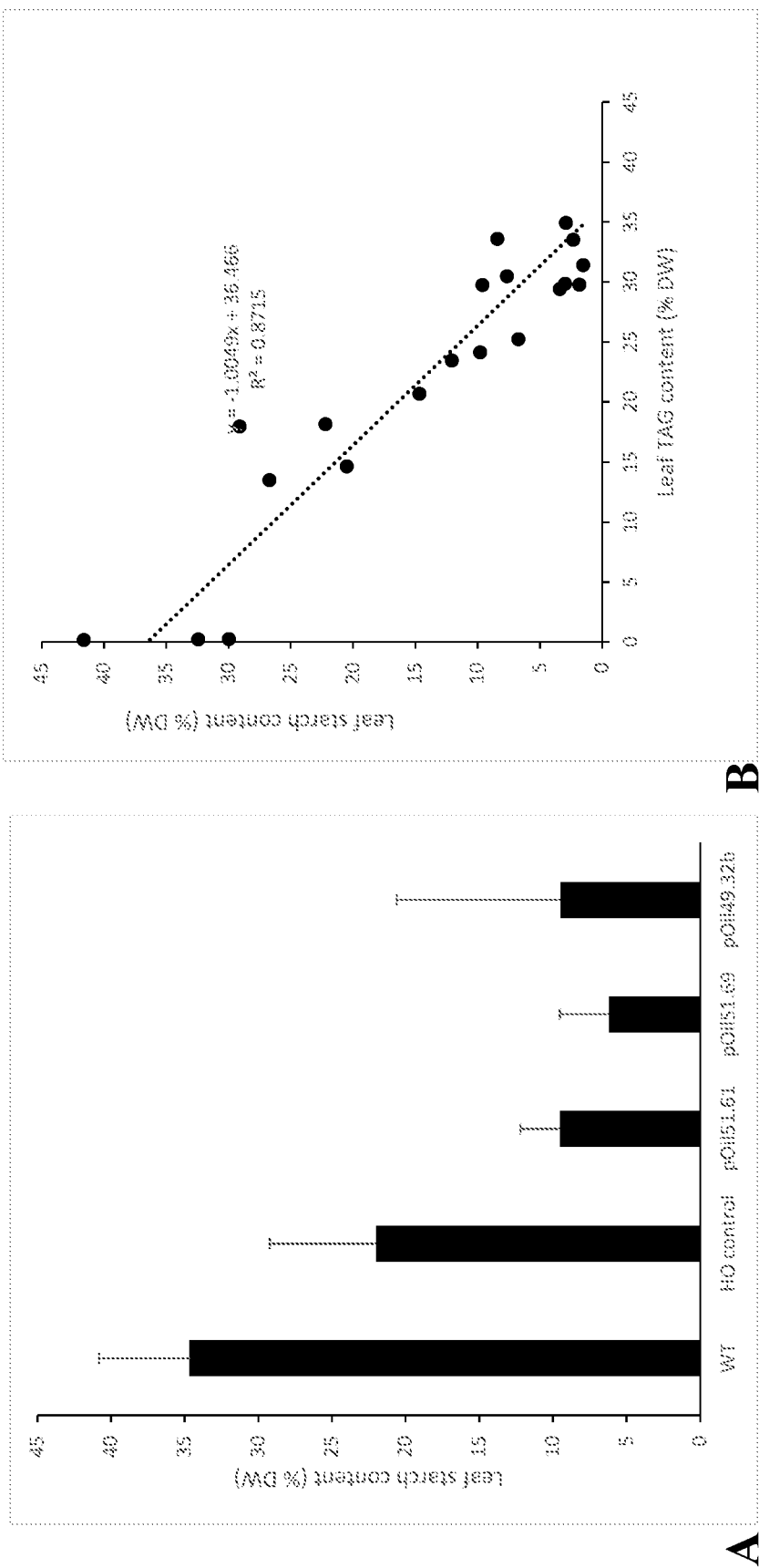

FIG. 7. A. Starch content in leaf tissue from wild-type plants (WT) and transgenic plants containing the T-DNA from pJP3502 (HO control) or the T-DNAs from both pJP3502 and pOIL051 (pOIL51.61 and pOIL51.69) or both pJP3502 and pOIL049 (pOIL49.32b). Data represent combined results from at least three individual plants. B. Correlation between starch and TAG content in leaf tissue of wild-type plants (WT) and transgenic plants containing the T-DNA from pJP3502 (HO control) or T-DNAs from both pJP3502 and pOIL051 (pOIL51.61 and pOIL51.69) or both pJP3502 and pOIL049 (pOIL49.32b). Data represent combined results from at least three individual plants.

Figure 8:
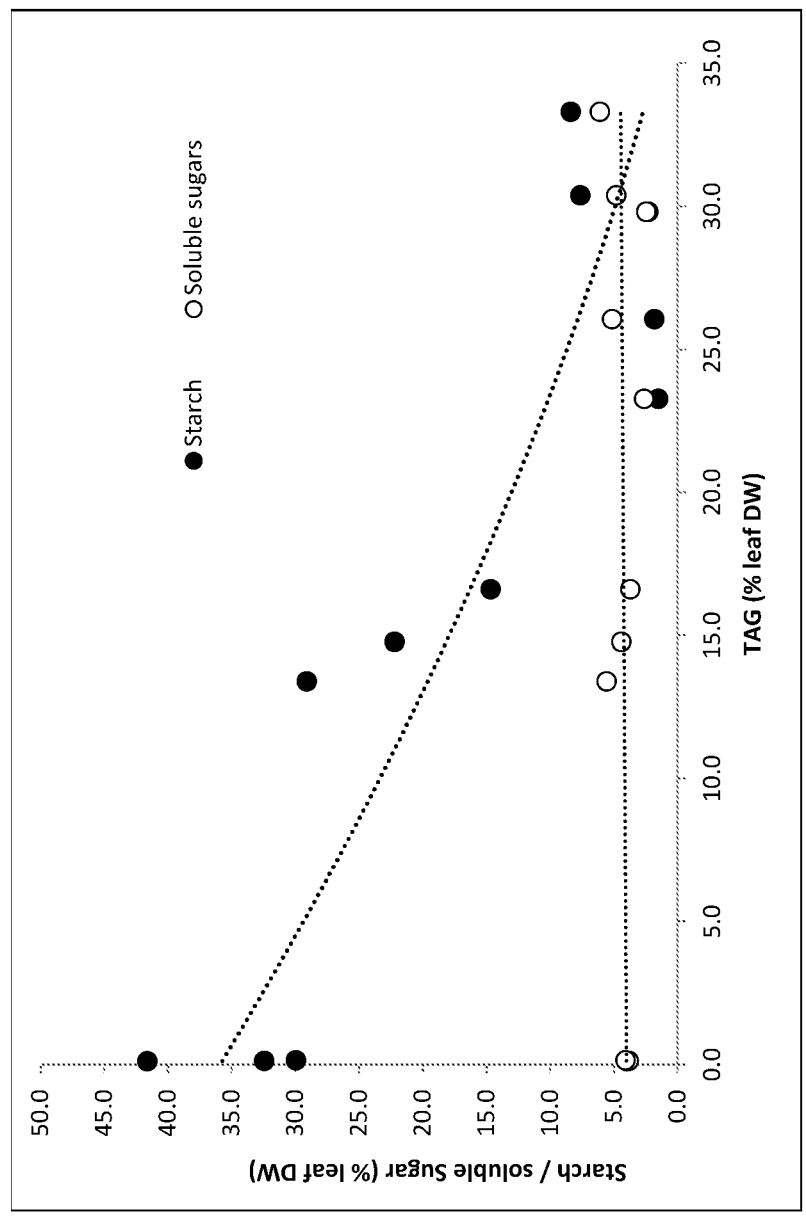

FIG. 8. Starch and soluble sugar contents on a dry weight (DW) basis in senescing leaves of wild-type plants (open circles) and transgenic plants (filled circles) (T1) sampled at seed setting stage. The transgenic *N. tabacum* plants included those designated HO, SDP1 and LEC2. In each case three plants were included in the analysis. Data points are based on triplicate analyses.

Figure 9:
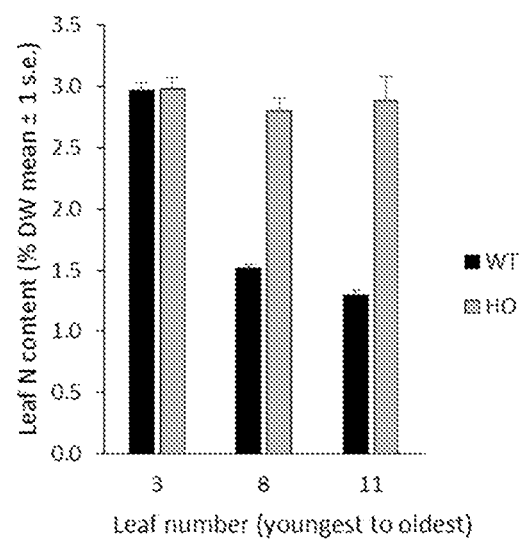
Figure 9:
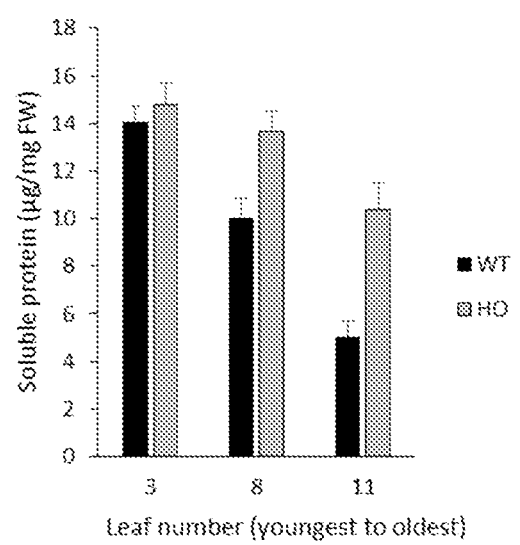

FIG. 9. Leaf N (A) and soluble protein (B) of WT and HO leaves of different ages harvested from plants 69 DAS.

Figure 10:
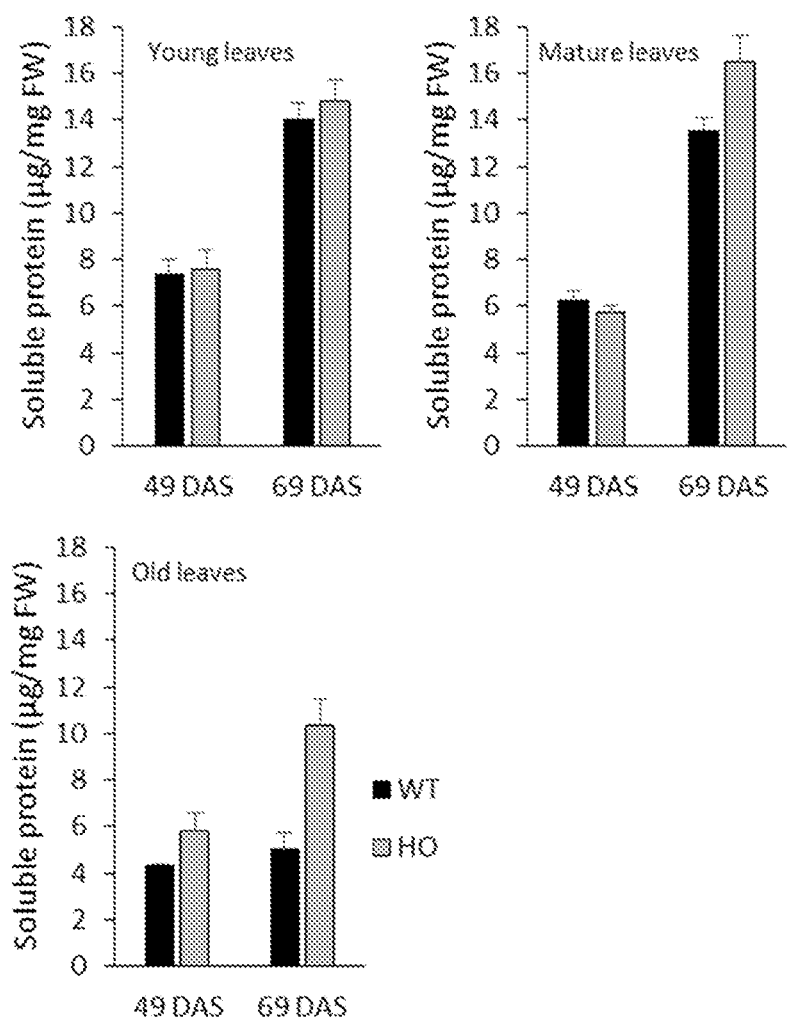

FIG. 10. Leaf soluble protein content in WT and HO tobacco as a function of leaf and plant age.

Figure 11:
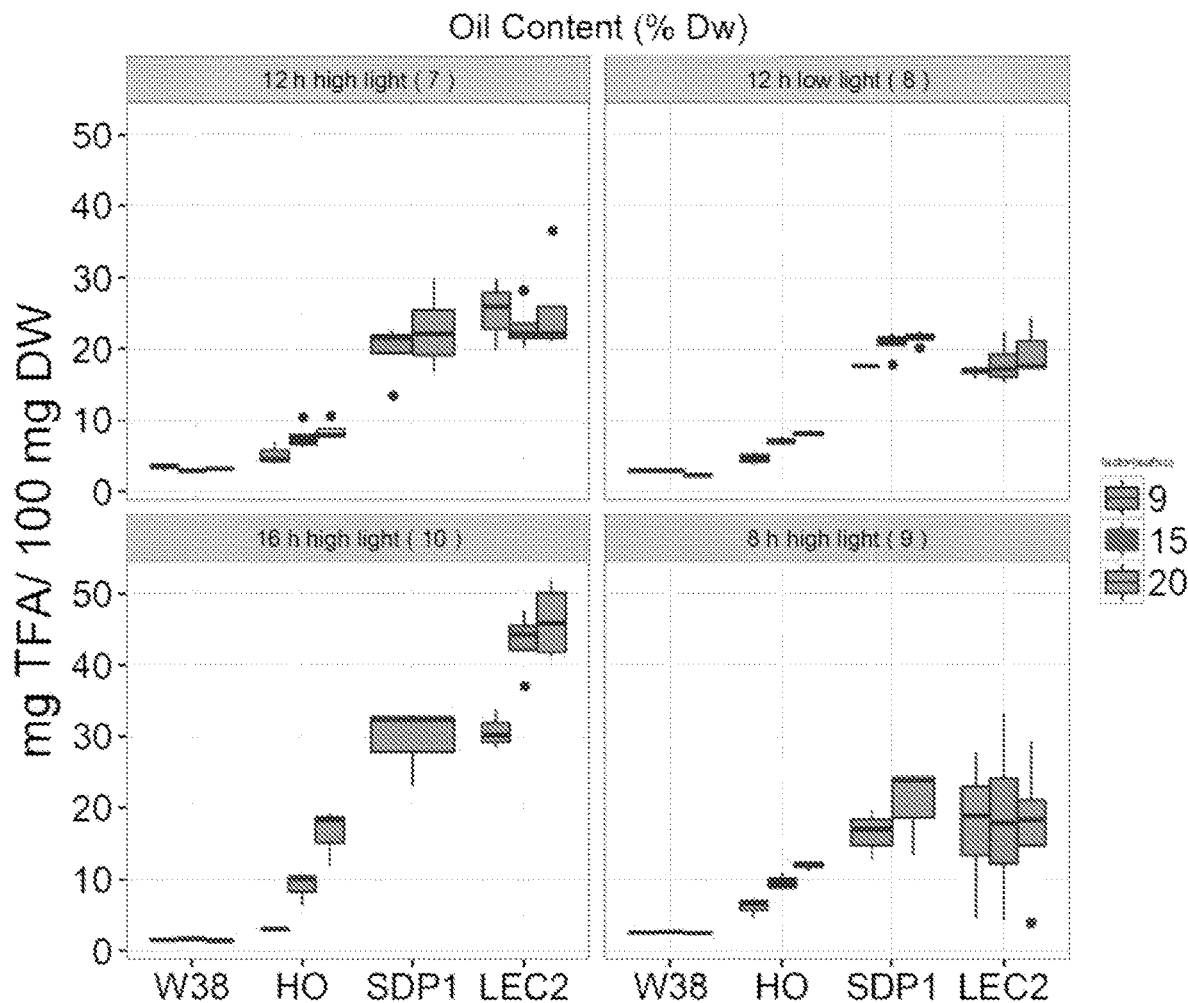

FIG. 11. Mean total fatty acid (TFA) content in mg/100 mg dry weight of leaves 9, 15 and 20 in tobacco plants grown under modified conditions: increased light intensity (top left panel); control (top right panel); increased photoperiod, increased light intensity and increased CO2 concentration (lower left panel); reduced photoperiod at high light intensity (lower right panel).

Figure 12:
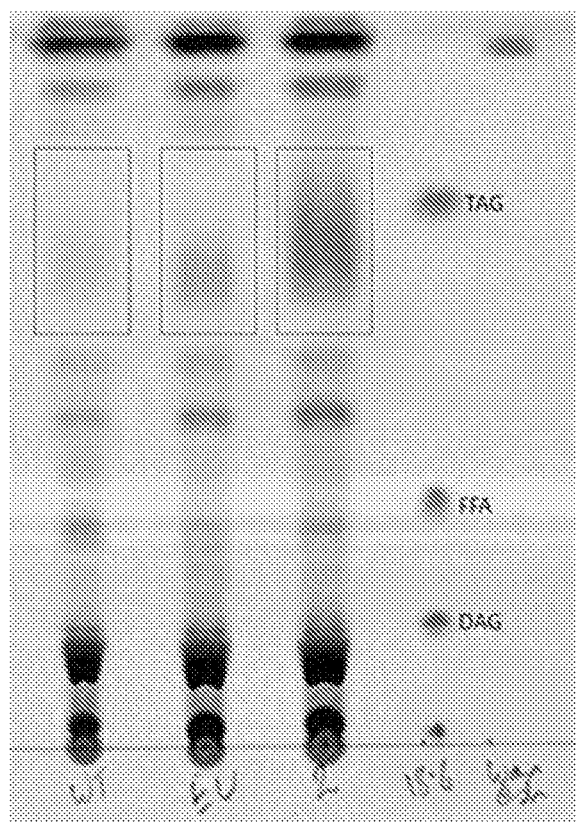

FIG. 12. TLC separation of total leaf lipids extracted from wildtype and transgenic *S. bicolor*. Wt, wildtype; EV, empty vector control; 2, *S. bicolor* transformed with pOIL136 (event 2); TAG, triacylglycerol; FFA, free fatty acids; DAG, diacylglycerol. Leaf tissue was harvested from young, vegetative plants following transfer to soil.

Figure 13:
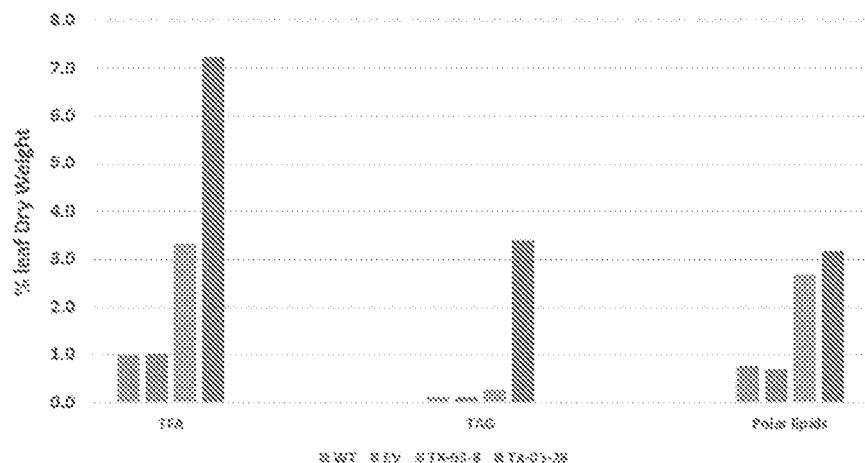
Figure 13:
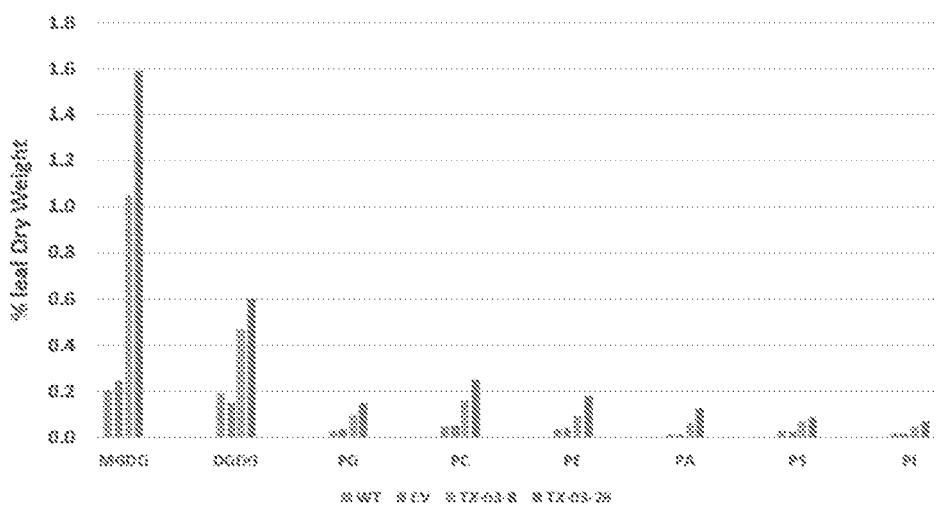

FIG. 13. A. Lipid levels in *sorghum* leaves transformed with a combination of the genetic constructs pOIL103 and pOIL197, at the vegetative stage of growth. The levels (weight % of dry weight) of TFA, TAG and polar lipids are shown. Each set of 4 bars show, in order, the levels in leaves from wild-type plants (WT, blue), empty vector control plants (EV, orange) and transgenic plants TX-03-8 (grey) and TX-03-38 (yellow). B. Levels of the galactolipids MGDG and DGDG and of the phospholipids PG, PC, PE, PA, PS and PI in the leaves as for A.

Figure 14:
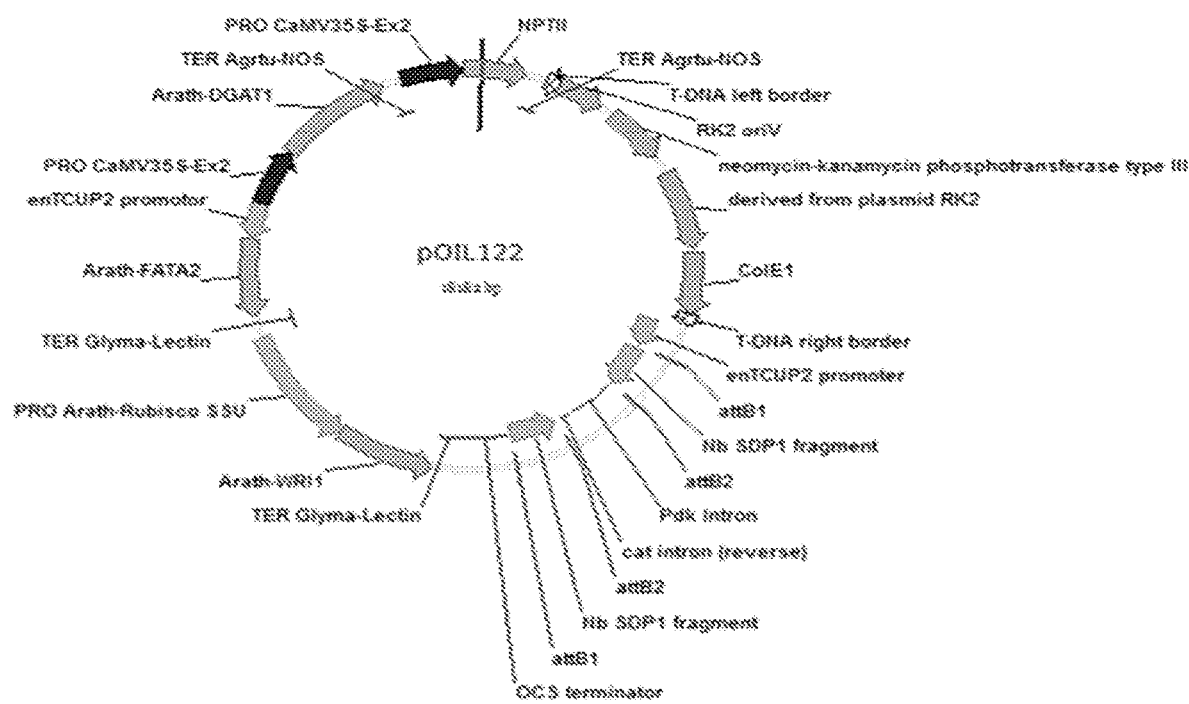

FIG. 14. Schematic diagram of vector pOIL122. Abbreviations: TER Agrtu-Nos, *Agrobacterium tumefaciens* nopaline synthase terminator; NPTII, neomycin phosphotransferase protein coding region; PRO CaMV35S-Ex2, Cauliflower Mosaic Virus 35S promoter with double enhancer region; Arath-DGAT1, *Arabidopsis thaliana* DGAT1 acyltransferase protein coding region; PRO Arath-Rubisco SSU, *A. thaliana* Rubisco small subunit promoter; Arath-FATA2, *A. thaliana* FATA2 thioesterase protein coding region; Arath-WRI, *A. thaliana* WRI1 transcription factor protein coding region; TER Glyma-Lectin, *Glycine max* lectin terminator; enTCUP2 promoter, *Nicotiana tabacum* cryptic constitutive promoter; attB1 and attB2, Gateway recombination sites; NB SDP1 fragment, *Nicotiana benthamiana* SDP1 region targeted for hpRNAi silencing; OCS terminator, *A. tumefaciens* octopine synthase terminator. Backbone features outside the T-DNA region are derived from pORE04 (Coutu et al., 2007).

Figure 15:
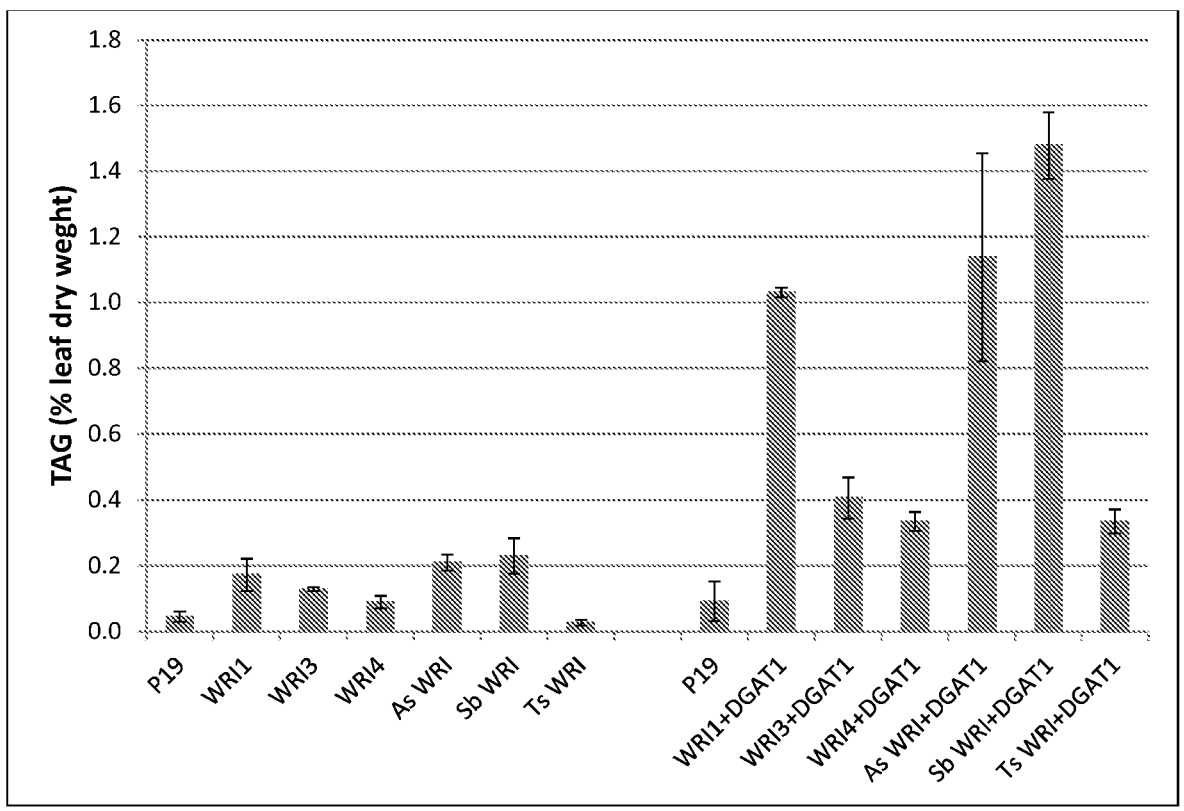

FIG. 15. TAG levels (% leaf dry weight) in *N. benthamiana* leaf tissue, infiltrated with genes encoding different WRI1 polypeptides either with (right hand bars) or without (left hand bars) co-expression of DGAT1 (n=3). All samples were infiltrated with the P19 construct as well.

Figure 16:
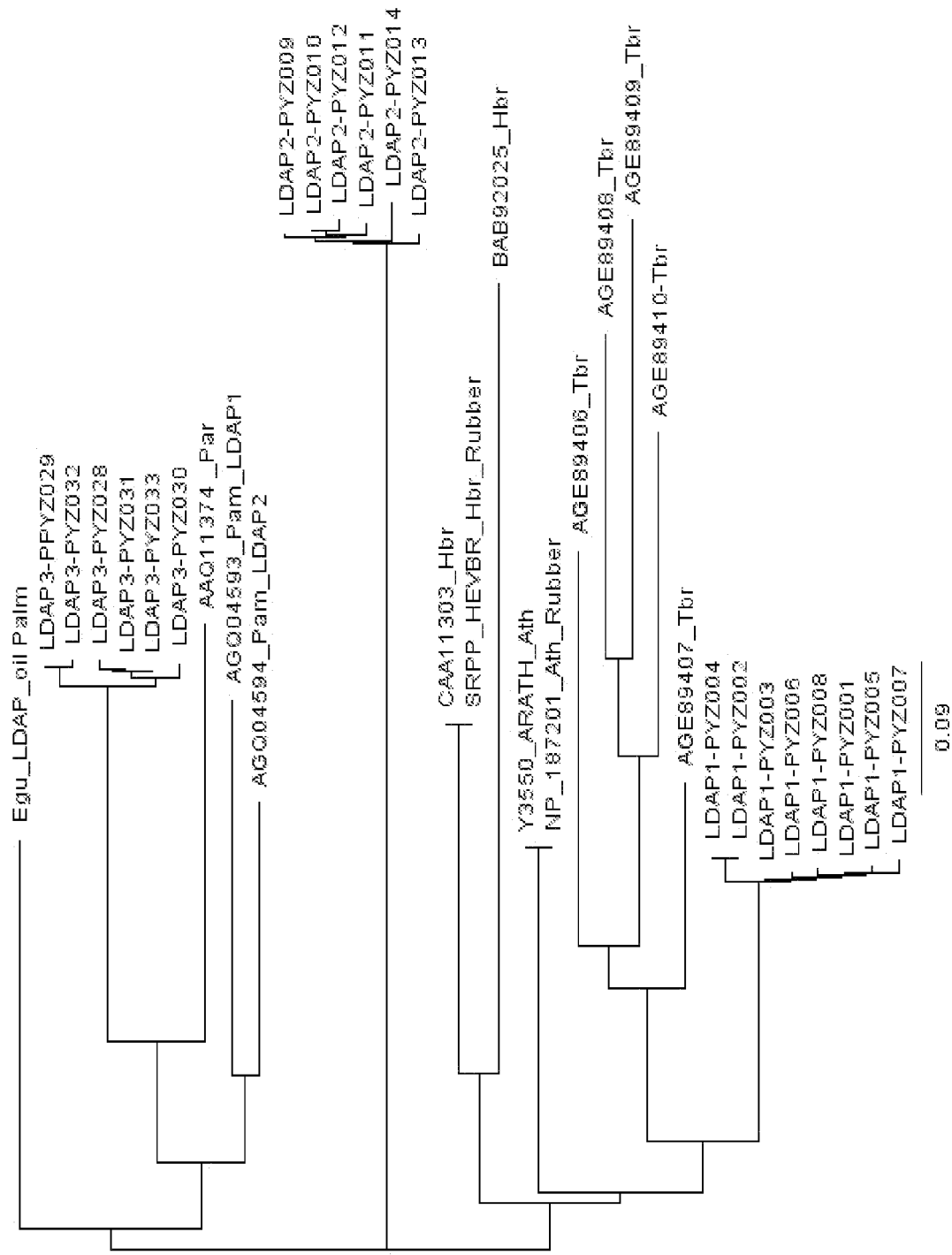

FIG. 16. Phylogenetic tree of LDAP polypeptides (Example 11).

Figure 17:
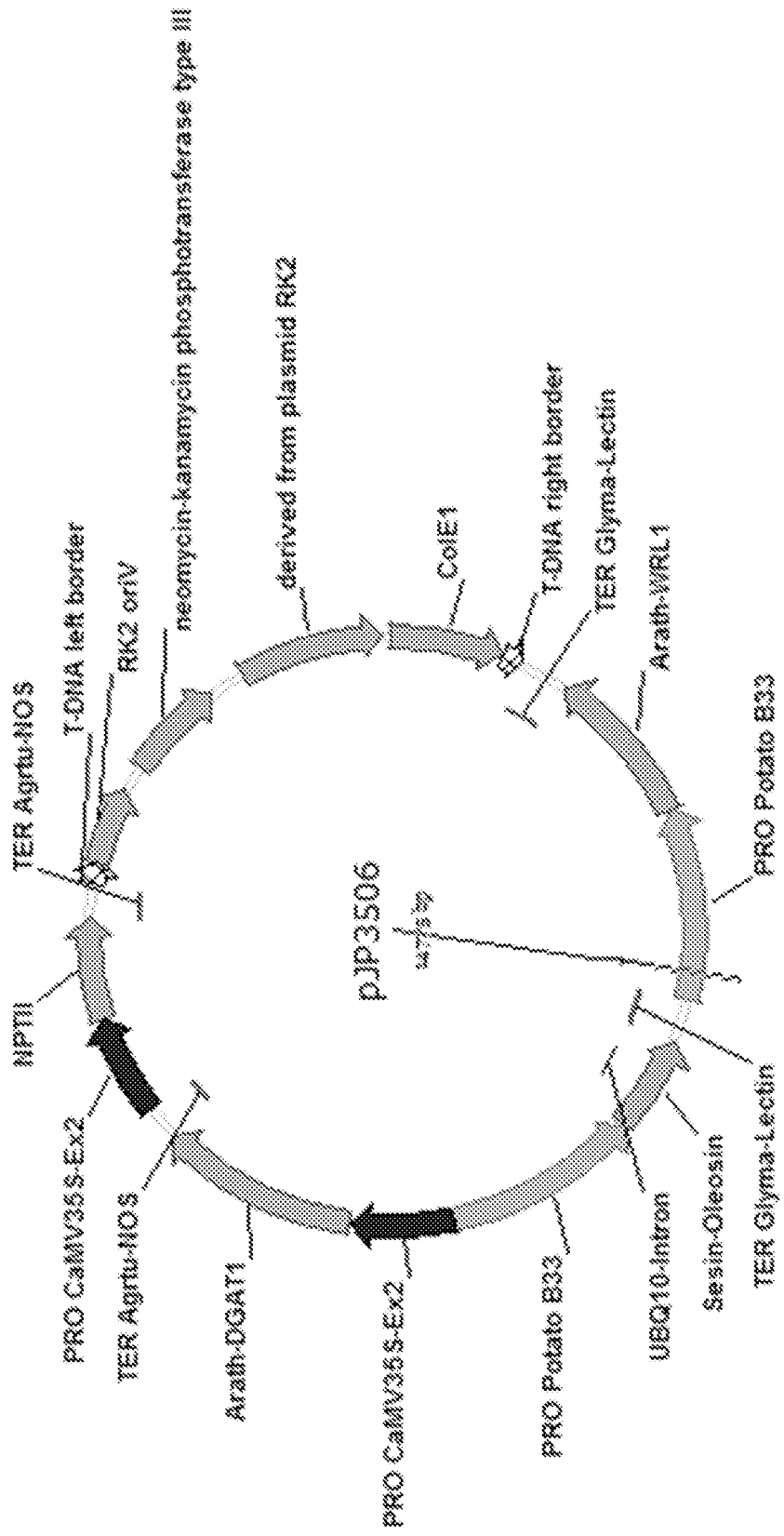

FIG. 17. Schematic representation of the genetic construct pJP3506 including the T-DNA region between the left and right borders. Abbreviations are as for FIG. 12 and: Sesin-Oleosin, *Sesame indicum* oleosin protein coding region.

Figure 18:
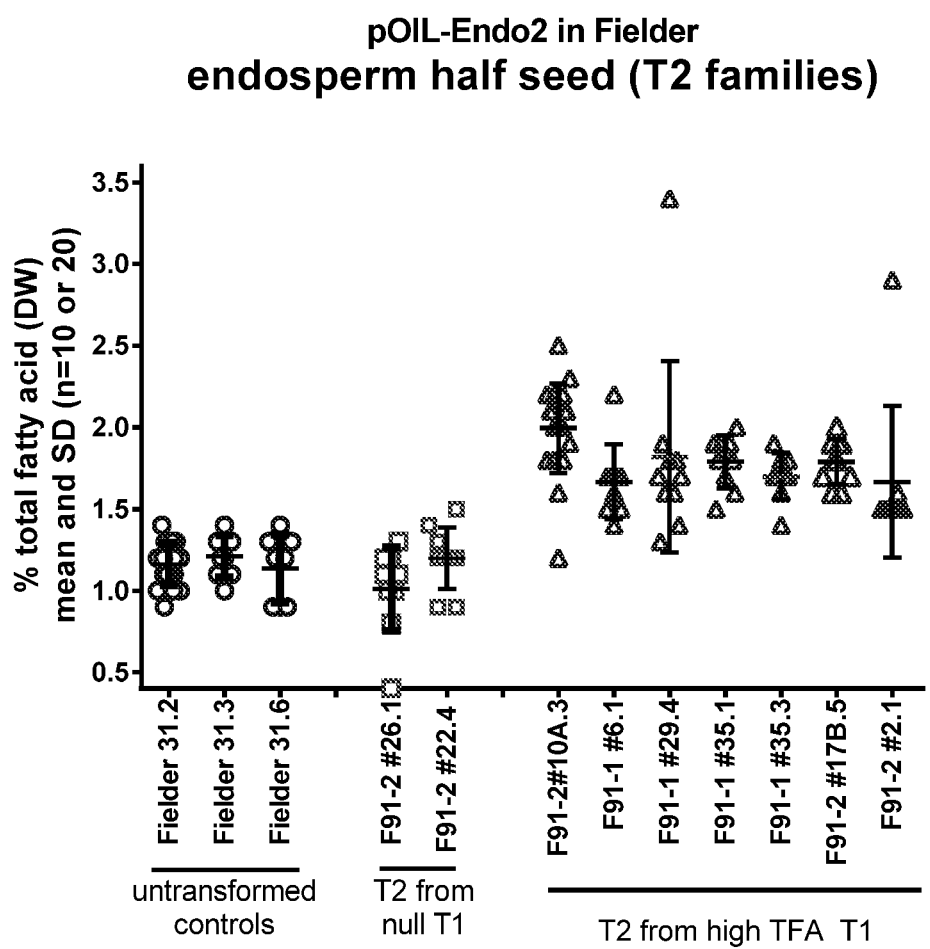

FIG. 18. Fatty acid content of transgenic wheat seed.

Figure 19:
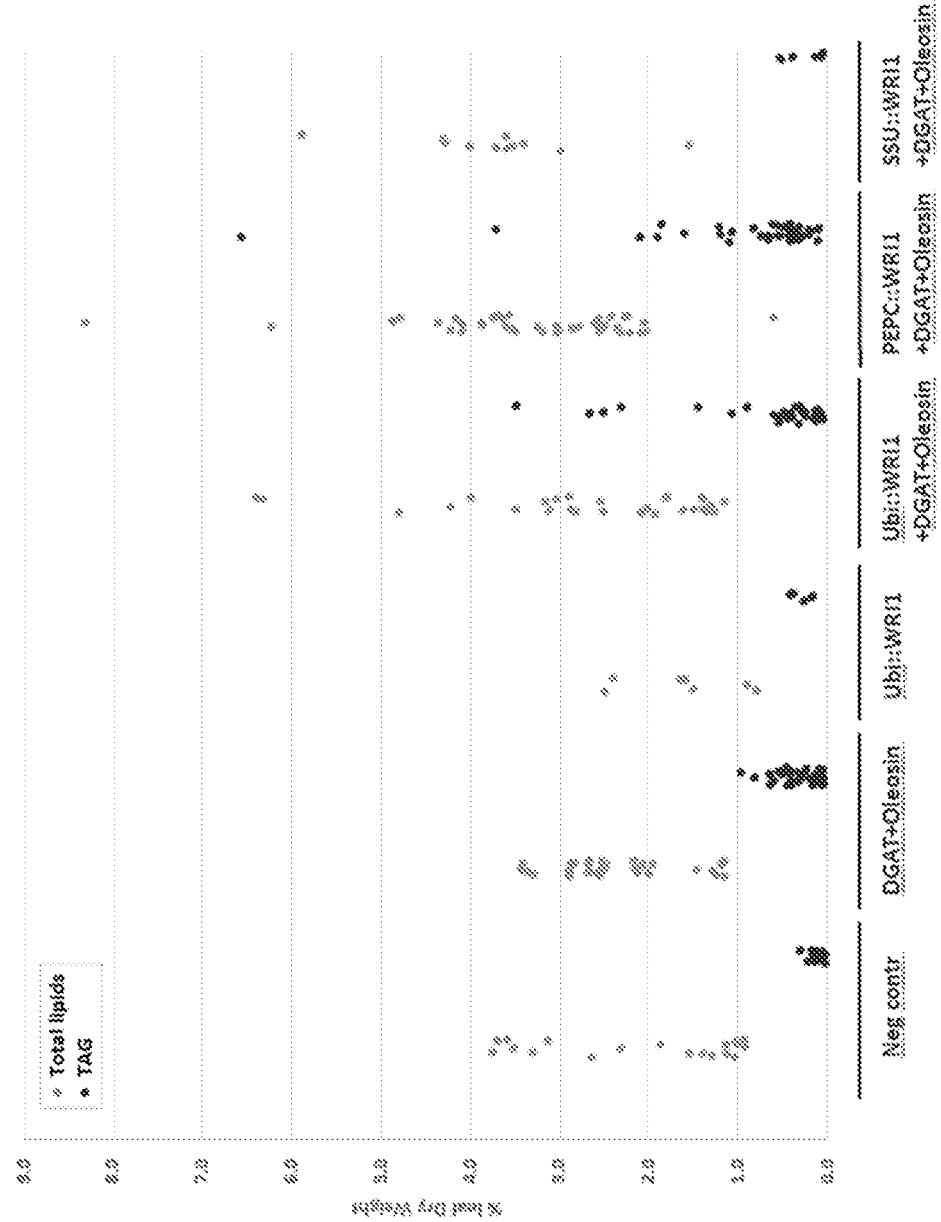

FIG. 19. Levels of TFA and TAG (weight % of leaf dry weight) in leaves of *sorghum* plants at the boot leaf stage of growth, for wild-type plants (Neg contr), plants transformed with a genetic construct to express DGAT and Oleosin (DGAT+Oleosin), plants transformed with a genetic construct to express WRI expressed from a Ubi promoter (Ubi::WRI1), plants transformed with genetic constructs to express DGAT, Oleosin and WRI expressed from a Ubi promoter (Ubi::WRI1+DGAT+Oleosin), plants transformed with genetic constructs to express DGAT, Oleosin and WRI expressed from a PEPC promoter (PEPC::WRI1+DGAT+Oleosin), plants transformed with genetic constructs to express DGAT, Oleosin and WRI expressed from a SSU promoter (SSU::WRI1+DGAT+Oleosin). Each dot represents the levels seen for an independent transgenic plant. For each plant type, the column of dots on the left (blue) shows TFA levels, and the column of dots on the right (red) shows TAG levels in the same set of plants.

Figure 20:
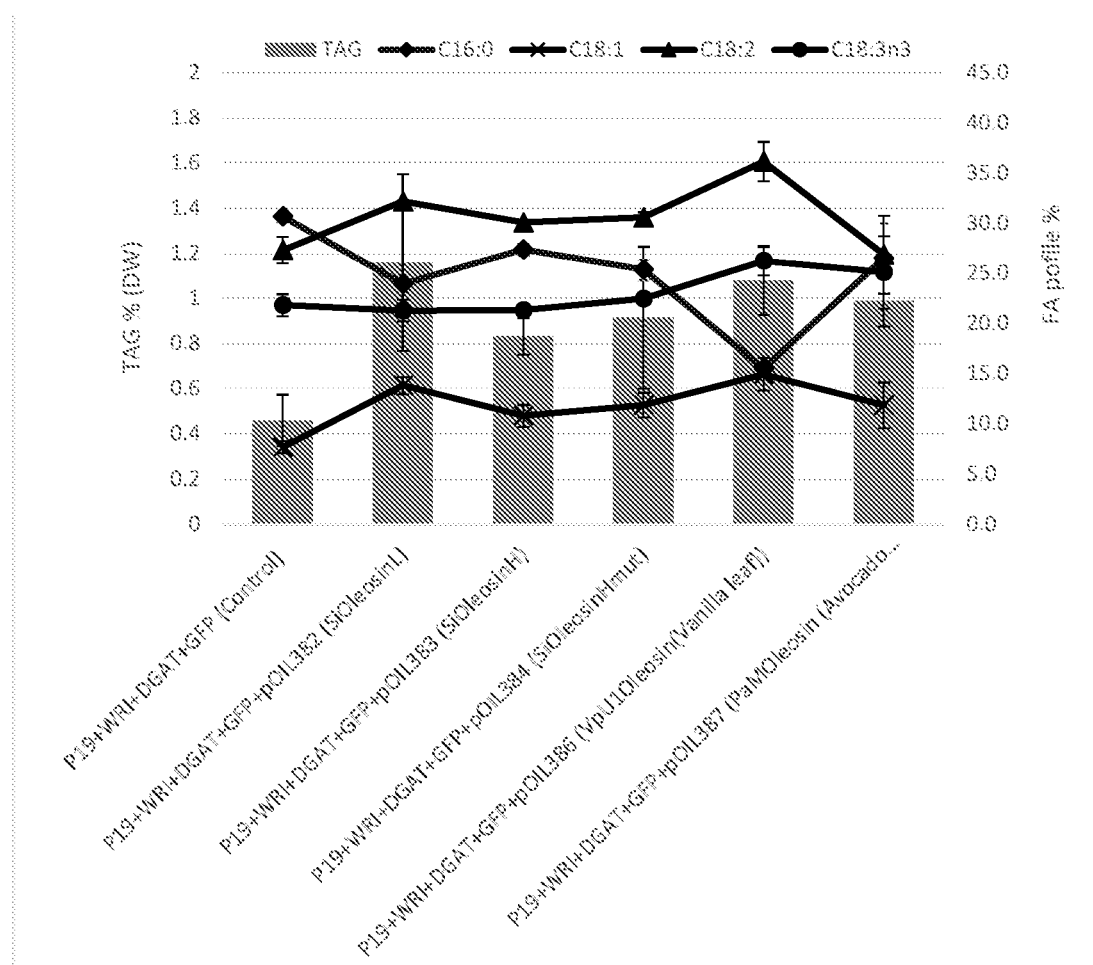

FIG. 20. TAG content and fatty acid composition for selected fatty acids in *N. benthamiana* leaf tissues after introduction of genes encoding WRI1, DGAT1 and an oil body polypeptide (pOIL382-387).

KEY TO THE SEQUENCE LISTING

SEQ ID NO:1 *Arabidopsis thaliana* DGAT1 polypeptide (CAB44774.1)
SEQ ID NO:2 *Arabidopsis thaliana* DGAT2 polypeptide (NP 566952.1)
SEQ ID NO:3 *Ricinus communis* DGAT2 polypeptide (AAY16324.1)
SEQ ID NO:4 *Vernicia fordii* DGAT2 polypeptide (ABC94474.1)
SEQ ID NO:5 *Mortierella ramanniana* DGAT2 polypeptide (AAK84179.1)
SEQ ID NO:6 *Homo sapiens* DGAT2 polypeptide (Q96PD7.2)
SEQ ID NO:7 *Homo sapiens* DGAT2 polypeptide (Q58HT5.1)
SEQ ID NO:8 *Bos taurus* DGAT2 polypeptide (Q70VZ8.1)
SEQ ID NO:9 *Mus musculus* DGAT2 polypeptide (AAK84175.1)
SEQ ID NO:10 YFP tripeptide—conserved DGAT2 and/or MGAT1/2 sequence motif
SEQ ID NO:11 HPHG tetrapeptide—conserved DGAT2 and/or MGAT1/2 sequence motif
SEQ ID NO:12 EPHS tetrapeptide—conserved plant DGAT2 sequence motif
SEQ ID NO:13 RXGFX(K/R)XAXXXGXXX(L/V)VPXXXFG(E/Q)—long conserved sequence motif of DGAT2 which is part of the putative glycerol phospholipid domain
SEQ ID NO:14 FLXLXXXN—conserved sequence motif of mouse DGAT2 and MGAT1/2 which is a putative neutral lipid binding domain
SEQ ID NO:15 plsC acyltransferase domain (PF01553) of GPAT
SEQ ID NO:16 HAD-like hydrolase (PF12710) superfamily domain of GPAT
SEQ ID NO:17 Phosphoserine phosphatase domain (PF00702). GPAT4-8 contain a N-terminal region homologous to this domain
SEQ ID NO:18 Conserved GPAT amino acid sequence GDLVICPEGTTCREP
SEQ ID NO:19 Conserved GPAT/phosphatase amino acid sequence (Motif I)
SEQ ID NO:20 Conserved GPAT/phosphatase amino acid sequence (Motif III)
SEQ ID NO:21 *Arabidopsis thaliana* WRI1 polypeptide (A8MS57)
SEQ ID NO:22 *Arabidopsis thaliana* WRI1 polypeptide (Q6X5Y6)
SEQ ID NO:23 *Arabidopsis lyrata* subsp. *lyrata* WRI1 polypeptide (XP_002876251.1)
SEQ ID NO:24 *Brassica napus* WRI1 polypeptide (ABD16282.1)
SEQ ID NO:25 *Brassica napus* WRI1 polypeptide (AD016346.1)
SEQ ID NO:26 *Glycine max* WRI1 polypeptide (XP_003530370.1)
SEQ ID NO:27 *Jatropha curcas* WRI1 polypeptide (AE022131.1)
SEQ ID NO:28 *Ricinus communis* WRI1 polypeptide (XP_002525305.1)
SEQ ID NO:29 *Populus trichocarpa* WRI1 polypeptide (XP_002316459.1)
SEQ ID NO:30 *Vitis vinifera* WRI1 polypeptide (CB129147.3)
SEQ ID NO:31 *Brachypodium distachyon* WRI1 polypeptide (XP_003578997.1)
SEQ ID NO:32 *Hordeum vulgare* subsp. *vulgare* WRI1 polypeptide (BAJ86627.1)
SEQ ID NO:33 *Oryza sativa* WRI1 polypeptide (EAY79792.1)
SEQ ID NO:34 *Sorghum bicolor* WRI1 polypeptide (XP_002450194.1)
SEQ ID NO:35 *Zea mays* WRI1 polypeptide (ACG32367.1)
SEQ ID NO:36 *Brachypodium distachyon* WRI1 polypeptide (XP_003561189.1)
SEQ ID NO:37 *Brachypodium sylvaticum* WRI1 polypeptide (ABL85061.1)
SEQ ID NO:38 *Oryza sativa* WRI1 polypeptide (BAD68417.1)
SEQ ID NO:39 *Sorghum bicolor* WRI1 polypeptide (XP_002437819.1)
SEQ ID NO:40 *Sorghum bicolor* WRI1 polypeptide (XP_002441444.1)

SEQ ID NO:41 *Glycine max* WRI1 polypeptide (XP_003530686.1)
SEQ ID NO:42 *Glycine max* WRI1 polypeptide (XP_003553203.1)
SEQ ID NO:43 *Populus trichocarpa* WRI1 polypeptide (XP_002315794.1)
SEQ ID NO:44 *Vitis vinifera* WRI1 polypeptide (XP_002270149.1)
SEQ ID NO:45 *Glycine max* WRI1 polypeptide (XP_003533548.1)
SEQ ID NO:46 *Glycine max* WRI1 polypeptide (XP_003551723.1)
SEQ ID NO:47 *Medicago truncatula* WRI1 polypeptide (XP_003621117.1)
SEQ ID NO:48 *Populus trichocarpa* WRI1 polypeptide (XP_002323836.1)
SEQ ID NO:49 *Ricinus communis* WRI1 polypeptide (XP_002517474.1)
SEQ ID NO:50 *Vitis vinifera* WRI1 polypeptide (CAN79925.1)
SEQ ID NO:51 *Brachypodium distachyon* WRI1 polypeptide (XP_003572236.1)
SEQ ID NO:52 *Oryza sativa* WRI1 polypeptide (BAD10030.1)
SEQ ID NO:53 *Sorghum bicolor* WRI1 polypeptide (XP_002444429.1)
SEQ ID NO:54 *Zea mays* WRI1 polypeptide (NP 001170359.1)
SEQ ID NO:55 *Arabidopsis lyrata* subsp. *lyrata* WRI1 polypeptide (XP_002889265.1)
SEQ ID NO:56 *Arabidopsis thaliana* WRI1 polypeptide (AAF68121.1)
SEQ ID NO:57 *Arabidopsis thaliana* WRI1 polypeptide (NP 178088.2)
SEQ ID NO:58 *Arabidopsis lyrata* subsp. *lyrata* WRI1 polypeptide (XP_002890145.1)
SEQ ID NO:59 *Thellungiella halophila* WRI1 polypeptide (BAJ33872.1)
SEQ ID NO:60 *Arabidopsis thaliana* WRI1 polypeptide (NP 563990.1)
SEQ ID NO:61 *Glycine max* WRI1 polypeptide (XP_003530350.1)
SEQ ID NO:62 *Brachypodium distachyon* WRI1 polypeptide (XP_003578142.1)
SEQ ID NO:63 *Oryza sativa* WRI1 polypeptide (EAZ09147.1)
SEQ ID NO:64 *Sorghum bicolor* WRI1 polypeptide (XP_002460236.1)
SEQ ID NO:65 *Zea mays* WRI1 polypeptide (NP 001146338.1)
SEQ ID NO:66 *Glycine max* WRI1 polypeptide (XP_003519167.1)
SEQ ID NO:67 *Glycine max* WRI1 polypeptide (XP_003550676.1)
SEQ ID NO:68 *Medicago truncatula* WRI1 polypeptide (XP_003610261.1)
SEQ ID NO:69 *Glycine max* WRI1 polypeptide (XP_003524030.1)
SEQ ID NO:70 *Glycine max* WRI1 polypeptide (XP_003525949.1)
SEQ ID NO:71 *Populus trichocarpa* WRI1 polypeptide (XP_002325111.1)
SEQ ID NO:72 *Vitis vinifera* WRI1 polypeptide (CBI36586.3)
SEQ ID NO:73 *Vitis vinifera* WRI1 polypeptide (XP_002273046.2)
SEQ ID NO:74 *Populus trichocarpa* WRI1 polypeptide (XP_002303866.1)
SEQ ID NO:75 *Vitis vinifera* WRI1 polypeptide (CBI25261.3)
SEQ ID NO:76 Sorbi-WRL1
SEQ ID NO: 77 Lupan-WRL1
SEQ ID NO:78 Ricco-WRL1
SEQ ID NO:79 *Lupin angustifolius* WRI1 polypeptide
SEQ ID NO:80 *Aspergillus fumigatus* DGAT1 polypeptide (XP_755172.1)
SEQ ID NO:81 *Ricinus communis* DGAT1 polypeptide (AAR11479.1)
SEQ ID NO:82 *Vernicia fordii* DGAT1 polypeptide (ABC94472.1)
SEQ ID NO:83 *Vernonia galamensis* DGAT1 polypeptide (ABV21945.1)
SEQ ID NO:84 *Vernonia galamensis* DGAT1 polypeptide (ABV21946.1)
SEQ ID NO:85 *Euonymus alatus* DGAT1 polypeptide (AAV31083.1)
SEQ ID NO:86 *Caenorhabditis elegans* DGAT1 polypeptide (AAF82410.1)
SEQ ID NO:87 *Rattus norvegicus* DGAT1 polypeptide (NP_445889.1)
SEQ ID NO:88 *Homo sapiens* DGAT1 polypeptide (NP_036211.2)
SEQ ID NO:89 WRI1 motif (R G V T/S R H R W T G R)
SEQ ID NO:90 WRI1 motif (F/Y E A H L W D K)
SEQ ID NO:91 WRI1 motif (D L A A L K Y W G)
SEQ ID NO:92 WRI1 motif (S X G F S/A R G X)
SEQ ID NO:93 WRI1 motif (H H H/Q N G R/K W E A R I G R/K V)
SEQ ID NO:94 WRI1 motif (Q E E A A A X Y D)
SEQ ID NO:95 *Brassica napus* oleosin polypeptide (CAA57545.1)
SEQ ID NO:96 *Brassica napus* oleosin S1-1 polypeptide (ACG69504.1)
SEQ ID NO:97 *Brassica napus* oleosin S2-1 polypeptide (ACG69503.1)
SEQ ID NO:98 *Brassica napus* oleosin S3-1 polypeptide (ACG69513.1)
SEQ ID NO:99 *Brassica napus* oleosin S4-1 polypeptide (ACG69507.1)
SEQ ID NO:100 *Brassica napus* oleosin S5-1 polypeptide (ACG69511.1)
SEQ ID NO:101 *Arachis hypogaea* oleosin 1 polypeptide (AAZ20276.1)
SEQ ID NO:102 *Arachis hypogaea* oleosin 2 polypeptide (AAU21500.1)
SEQ ID NO:103 *Arachis hypogaea* oleosin 3 polypeptide (AAU21501.1)
SEQ ID NO:104 *Arachis hypogaea* oleosin 5 polypeptide (ABC96763.1)
SEQ ID NO:105 *Ricinus communis* oleosin 1 polypeptide (EEF40948.1)
SEQ ID NO:106 *Ricinus communis* oleosin 2 polypeptide (EEF51616.1)
SEQ ID NO:107 *Glycine max* oleosin isoform a polypeptide (P29530.2)
SEQ ID NO:108 *Glycine max* oleosin isoform b polypeptide (P29531.1)
SEQ ID NO:109 *Linum usitatissimum* oleosin low molecular weight isoform polypeptide (ABB01622.1)
SEQ ID NO:110 amino acid sequence of *Linum usitatissimum* oleosin high molecular weight isoform polypeptide (ABB01624.1)

SEQ ID NO:111 *Helianthus annuus* oleosin polypeptide (CAA44224.1)
SEQ ID NO:112 *Zea mays* oleosin polypeptide (NP_001105338.1)
SEQ ID NO:113 *Brassica napus* steroleosin polypeptide (ABM30178.1)
SEQ ID NO:114 *Brassica napus* steroleosin SLO1-1 polypeptide (ACG69522.1)
SEQ ID NO:115 *Brassica napus* steroleosin SLO2-1 polypeptide (ACG69525.1)
SEQ ID NO:116 *Sesamum indicum* steroleosin polypeptide (AAL13315.1)
SEQ ID NO:117 *Zea mays* steroleosin polypeptide (NP_001152614.1)
SEQ ID NO:118 *Brassica napus* caleosin CLO-1 polypeptide (ACG69529.1)
SEQ ID NO:119 *Brassica napus* caleosin CLO-3 polypeptide (ACG69527.1)
SEQ ID NO:120 *Sesamum indicum* caleosin polypeptide (AAF13743.1)
SEQ ID NO:121 *Zea mays* caleosin polypeptide (NP_001151906.1)
SEQ ID NO:122 pJP3502 TDNA (inserted into genome) sequence
SEQ ID NO:123 pJP3507 vector sequence
SEQ ID NO:124 Linker sequence
SEQ ID NO:125 Partial *Nicotiana benthamiana* CGI-58 sequence selected for hpRNAi silencing (pTV46)
SEQ ID NO:126 Partial *N. tabacum* AGPase sequence selected for hpRNAi silencing (pTV35)
SEQ ID NO:127 GXSXG lipase motif
SEQ ID NO:128 HX(4)D acyltransferase motif
SEQ ID NO:129 VX(3)HGF probable lipid binding motif
SEQ ID NO:130 *Arabidopsis thaliana* CGi58 polynucleotide (NM_118548.1)
SEQ ID NO:131 *Brachypodium distachyon* CGi58 polynucleotide (XM_003578402.1)
SEQ ID NO:132 *Glycine max* CGi58 polynucleotide (XM_003523590.1)
SEQ ID NO:133 *Zea mays* CGi58 polynucleotide (NM_001155541.1)
SEQ ID NO:134 *Sorghum bicolor* CGi58 polynucleotide (XM_002460493.1)
SEQ ID NO:135 *Ricinus communis* CGi58 polynucleotide (XM_002510439.1)
SEQ ID NO:136 *Medicago truncatula* CGi58 polynucleotide (XM_003603685.1)
SEQ ID NO:137 *Arabidopsis thaliana* LEC2 polynucleotide (NM_102595.2)
SEQ ID NO:138 *Medicago truncatula* LEC2 polynucelotide (X60387.1)
SEQ ID NO:139 *Brassica napus* LEC2 polynucelotide (HM370539.1)
SEQ ID NO:140 *Arabidopsis thaliana* BBM polynucleotide (NM_121749.2)
SEQ ID NO:141 *Medicago truncatula* BBM polynucleotide (AY899909.1)
SEQ ID NO:142 *Arabidopsis thaliana* LEC2 polypeptide (NP_564304.1)
SEQ ID NO:143 *Medicago truncatula* LEC2 polypeptide (CAA42938.1)
SEQ ID NO:144 *Brassica napus* LEC2 polypeptide (AD016343.1)
SEQ ID NO:145 *Arabidopsis thaliana* BBM polypeptide (NP_197245.2)
SEQ ID NO:146 *Medicago truncatula* BBM polypeptide (AAW82334.1)
SEQ ID NO:147 Inducible *Aspergillus niger* alcA promoter
SEQ ID NO:148 AlcR inducer that activates the AlcA promotor in the presence of ethanol
SEQ ID NO:149 *Arabidopsis thaliana* LEC1; (AAC39488)
SEQ ID NO:150 *Arabidopsis lyrata* LEC1 (XP_002862657)
SEQ ID NO:151 *Brassica napus* LEC1 (ADF81045)
SEQ ID NO:152 *Ricinus communis* LEC1 (XP_002522740)
SEQ ID NO:153 *Glycine max* LEC1 (XP_006582823)
SEQ ID NO:154 *Medicago truncatula* LEC1 (AFK49653)
SEQ ID NO:155 *Zea mays* LEC1 (AAK95562)
SEQ ID NO:156 *Arachis hypogaea* LEC1 (ADC33213)
SEQ ID NO:157 *Arabidopsis thaliana* LEC1-like (AAN15924)
SEQ ID NO:158 *Brassica napus* LEC1-like (AHI94922)
SEQ ID NO:159 *Phaseolus coccineus* LEC1-like (AAN01148)
SEQ ID NO:160 *Arabidopsis thaliana* FUS3 (AAC35247)
SEQ ID NO:161 *Brassica napus* FUS3
SEQ ID NO:162 *Medicago truncatula* FUS3
SEQ ID NO:163 *Arabidopsis thaliana* SDP1 cDNA sequence, Accession No. NM_120486, 3275 nt
SEQ ID NO:164 *Brassica napus* SDP1 cDNA; Accession No. GN078290
SEQ ID NO:165 *Brachypodium distachyon* SDP1 cDNA, 2670 nt
SEQ ID NO:166 *Populus trichocarpa* SDP1 cDNA, 3884 nt
SEQ ID NO:167 *Medicago truncatula* SDP1 cDNA; XM_003591377; 2490 nt
SEQ ID NO:168 *Glycine max* SDP1 cDNA XM_003521103; 2783 nt
SEQ ID NO:169 *Sorghum bicolor* SDP1 cDNA XM_002458486; 2724 nt
SEQ ID NO:170 *Zea mays* SDP1 cDNA, NM_001175206; 2985 nt
SEQ ID NO:171 *Physcomitrella patens* SDP1 cDNA, XM_001758117; 1998 nt
SEQ ID NO:172 *Hordeum vulgare* SDP1 cDNA, AK372092; 3439 nt
SEQ ID NO:173 *Nicotiana benthamiana* SDP1 cDNA, Nbv5tr6404201
SEQ ID NO:174 *Nicotiana benthamiana* SDP1 cDNA region targeted for hpRNAi silencing
SEQ ID NO:175 Promoter of *Arabidopsis thaliana* SDP1 gene, 1.5 kb
SEQ ID NO:176 Nucleotide sequence of the complement of the pSSU-Oleosin gene in the T-DNA of pJP3502. In order (complementary sequences): *Glycine max* Lectin terminator 348 nt, 3' exon 255 nt, UBQ10 intron 304 nt, 5' exon 213 nt, SSU promoter 1751 nt
SEQ ID NO:177 *Arabidopsis thaliana* plastidial GPAT cDNA, NM_179407
SEQ ID NO:178 *Arabidopsis thaliana* plastidial GPAT polypeptide, NM_179407
SEQ ID NO:179 *Populus trichocarpa* plastidial GPAT cDNA, XP_006368351
SEQ ID NO:180 *Jatropha curcas* plastidial GPAT cDNA, ACR61638
SEQ ID NO:181 *Ricinus communis* plastidial GPAT cDNA, XP_002518993
SEQ ID NO:182 *Helianthus annuus* plastidial GPAT cDNA, ADV16382
SEQ ID NO:183 *Medicago truncatula* plastidial GPAT cDNA, XP_003612801
SEQ ID NO:184 *Glycine max* plastidial GPAT cDNA, XP_003516958
SEQ ID NO:185 *Carthamus tinctorius* plastidial GPAT cDNA, CAHG3PACTR SEQ ID NO:186 *Solanum tuberosum* plastidial GPAT cDNA, XP_006352898
SEQ ID NO:187 *Oryza sativa Japonica* plastidial GPAT cDNA, NM_001072027
SEQ ID NO:188 *Sorghum bicolor* plastidial GPAT cDNA, XM_002467381
SEQ ID NO:189 *Zea mays* plastidial GPAT cDNA, NM_001158637
SEQ ID NO:190 *Hordeum vulgare* plastidial GPAT cDNA, AK371419
SEQ ID NO:191 *Physcomitrella patens* plastidial GPAT cDNA, XM_001771247
SEQ ID NO:192 *Chlamydomonas reinhardtii* plastidial GPAT cDNA, XM_001694925
SEQ ID NO:193 *Arabidopsis thaliana* FATA1
SEQ ID NO:194 *Arabidopsis thaliana* FATA2
SEQ ID NO:195 *Arabidopsis thaliana* FATB
SEQ ID NO:196 *Arabidopsis thaliana* WRI3
SEQ ID NO:197 *Arabidopsis thaliana* WRI4
SEQ ID NO:198 *Avena sativa* WRI1
SEQ ID NO:199 *Sorghum bicolor* WRI1
SEQ ID NO:200 *Zea mays* WRI1
SEQ ID NO:201 *Triadica sebifera* WRH
SEQ ID NO:202 *S. tuberosum* Patatin B33 promoter sequence
SEQ ID NOs 203 to 206 and 236 to 245 Oligonucleotide primers
SEQ ID NO:207 *Z. mays* SEE1 promoter region (1970 nt from Accession number AJ494982)
SEQ ID NO:208 *A. littoralis* AlSAP promoter sequence, Accession No DQ885219
SEQ ID NO:209 *A. rhizogenes* ArRolC promoter sequence, Accession No. DQ160187
SEQ ID NO:210 hpRNAi construct containing a 732 bp fragment of *N. benthamiana* plastidial GPAT
SEQ ID NO:211 *Elaeis guineensis* (oil palm) DGAT1
SEQ ID NO:212 *G. max* MYB73, Accession No. ABH02868
SEQ ID NO:213 *A. thaliana* bZIP53, Accession No. AAM14360
SEQ ID NO:214 *A. thaliana* AGL15, Accession No NP_196883
SEQ ID NO:215 *A. thaliana* MYB118, Accession No. AAS58517
SEQ ID NO:216 *A. thaliana* MYB115, Accession No. AAS10103
SEQ ID NO:217 *A. thaliana* TANMEI, Accession No. BAE44475
SEQ ID NO:218 *A. thaliana* WUS, Accession No. NP_565429
SEQ ID NO:219 *B. napus* GFR2a1, Accession No. AFB74090
SEQ ID NO:220 *B. napus* GFR2a2, Accession No. AFB74089
SEQ ID NO:221 *A. thaliana* PHR1, Accession No. AAN72198
SEQ ID NO:222 *N. benthamiana* TGD1 fragment
SEQ ID NO:223 Potato SDP1 amino acid
SEQ ID NO:224 Potato SDP1 nucleotide sequence
SEQ ID NO:225 Potato AGPase small subunit
SEQ ID NO:226 Potato AGPase small subunit nucleotide sequence:
SEQ ID NO:227 *Sapium sebiferum* LDAP-1 nucleotide sequence
SEQ ID NO:228 *Sapium sebiferum* LDAP-1 amino acid sequence
SEQ ID NO:229 *Sapium sebiferum* LDAP-2 nucleotide sequence
SEQ ID NO:230 *Sapium sebiferum* LDAP-2 amino acid sequence
SEQ ID NO:231 *Sapium sebiferum* LDAP-3 nucleotide sequence
SEQ ID NO:232 *Sapium sebiferum* LDAP-3 amino acid sequence
SEQ ID NO:233 *S. bicolor* SDP1 (accession number XM_002463620)
SEQ ID NO:234 *T. aestivum* SDP1 nucleotide sequence (Accession number AK334547)
SEQ ID NO:235 *S. bicolor* SDP1 hpRNAi fragment.
SEQ ID NO:246 *Saccharum* hybrid DIRIGENT (DIR16) promoter sequence
SEQ ID NO:247 *Saccharum* hybrid 0-Methyl transferase (OMT) promoter sequence
SEQ ID NO:248 Sequence of the A1 promoter allele of the *Saccharum* hybrid R1MYB1 gene
SEQ ID NO:249 *Saccharum* hybrid Loading Stem Gene 5 (LSG5) promoter sequence
SEQ ID NO:250 Nucleotide sequence of the protein coding region of the cDNA for *Sorghum bicolor* TGD5 gene, Accession No. XM_002442154; 297 nt
SEQ ID NO:251 Amino acid sequence of *Sorghum bicolor* TGD5 polypeptide, Accession No. XM_002442154; 98aa
SEQ ID NO:252 Nucleotide sequence of the protein coding region of the cDNA for *Zea mays* TGD5 gene, Accession No. EU972796.1; 297 nt
SEQ ID NO:253 Amino acid sequence of *Zea mays* TGD5 polypeptide, Accession No. EU972796.1; 98aa
SEQ ID NO:254 Nucleotide sequence of the protein coding region of the cDNA for *Sorghum bicolor* gene encoding AGPase small subunit (Accession No. XM_002462095.1); 1533 nt
SEQ ID NO:255 Amino acid sequence of *Sorghum bicolor* AGPase small subunit polypeptide (Accession No. XM_002462095.1); 510aa
SEQ ID NO:256 Nucleotide sequence of the protein coding region of the cDNA for *Zea mays* gene encoding AGPase small subunit polypeptide (Accession No. XM_008666513.1); 1554 nt
SEQ ID NO:257 Amino acid sequence of *Zea mays* AGPase small subunit polypeptide (Accession No. XM_008666513.1); 517aa
SEQ ID NO:258 Nucleotide sequence of the protein coding region of the cDNA for *Sorghum bicolor* PDAT1 gene (Accession No. XM_002462417.1);
SEQ ID NO:259 Amino acid sequence of *Sorghum bicolor* PDAT1 polypeptide (Accession No. XM_002462417.1); 682aa
SEQ ID NO:260 Nucleotide sequence of the protein coding region of the cDNA for *Zea mays* PDAT1 gene (Accession No. NM_001147943); 2037 nt
SEQ ID NO:261 Amino acid sequence of *Zea mays* PDAT1 polypeptide (Accession No. NM_001147943); 678aa
SEQ ID NO:262 Nucleotide sequence of the protein coding region of a cDNA for *Sorghum bicolor* PDCT gene (Accession No. XM_002437214); 846 nt
SEQ ID NO:263 Amino acid sequence of a *Sorghum bicolor* PDCT polypeptide (Accession No. XM_002437214); 281aa
SEQ ID NO:264 Nucleotide sequence of the protein coding region of the cDNA for *Zea mays* PDCT gene (Accession No. EU973573.1); 849 nt
SEQ ID NO:265 Amino acid sequence of *Zea mays* PDCT polypeptide (Accession No. EU973573.1); 282aa SEQ ID NO:266 Nucleotide sequence of the protein coding region of the cDNA for *Sorghum bicolor* TST1 gene (Accession No. XM_002467535.1); 2223 nt SEQ ID NO:267 Amino acid sequence of *Sorghum bicolor* TST1 polypeptide (Accession No. XM_002467535.1); 740aa SEQ ID NO:268 Nucleotide sequence of the protein coding region of the cDNA for *Zea mays* TST1 gene (Accession No. NM_001158464); 2244 nt SEQ ID NO:269 Amino acid sequence of *Zea mays* TST1 polypeptide (Accession No. NM_001158464); 747aa SEQ ID NO:270 Nucleotide sequence of the protein coding region of the cDNA for *Sorghum bicolor* TST2 gene (Sb04G008150; Sobic.004G099300; Accession No. KXG29849.1); 2238 nt SEQ ID NO:271 Amino acid sequence of *Sorghum bicolor* TST2 polypeptide (Accession No. KXG29849.1); 745aa SEQ ID NO:272 Nucleotide sequence of the protein coding region of the cDNA for *Zea mays* TST2 gene (Accession No. XM_008647398.1); 2238 nt SEQ ID NO:273 Amino acid sequence of *Zea mays* TST2 polypeptide (Accession No. XM_008647398.1); 745aa SEQ ID NO:274 Nucleotide sequence of the protein coding region of the cDNA for *Sorghum bicolor* INV3 gene (Sobic.004G004800; Sb04g000620; Accession No. XM_002451312); 1464 nt SEQ ID NO:275 Amino acid sequence of *Sorghum bicolor* INV3 polypeptide (Accession No. XM_002451312); 487aa SEQ ID NO:276 Amino acid sequence of *Sorghum bicolor* INV3 polypeptide; alternative longer splicing form (Accession No. EES04332.2); 638aa SEQ ID NO:277 Nucleotide sequence of the protein coding region of the cDNA for *Zea mays* INV2 gene (maize homolog to Sb INV3) (Accession No. NM_001305860.1); 2022 nt SEQ ID NO:278 Amino acid sequence of *Zea mays* INV2 polypeptide (maize homolog to Sb INV3) (Accession No. NM_001305860.1); 673aa SEQ ID NO:279 Nucleotide sequence of the protein coding region of the cDNA for *Sorghum bicolor* SUS4 gene (Sobic.001G344500; Sb01g033060; Accession No. XM_002465116.1); 2451 nt SEQ ID NO:280 Amino acid sequence of *Sorghum bicolor* SUS4 polypeptide (Accession No. XM_002465116.1); 816aa SEQ ID NO:281 Nucleotide sequence of the protein coding region of the cDNA for *Zea mays* SUS1 gene (maize homolog to Sb SUS4) (Accession No. NM_001111853); 2451 nt SEQ ID NO:282 Amino acid sequence of *Zea mays* SUS1 polypeptide (Accession No. NM_001111853); 816aa SEQ ID NO:283 Nucleotide sequence of the protein coding region of the cDNA for *Sorghum bicolor* bCIN gene (Sobic.004G172700; Sb04g022350; Accession No. XM_002453920.1);

SEQ ID NO:284 Amino acid sequence of *Sorghum bicolor* bCIN polypeptide (Accession No. XM_002453920.1); 559aa SEQ ID NO:285 Nucleotide sequence of the protein coding region of the cDNA for *Zea mays* cytosolic INV gene (homolog of Sb bCIN) (Accession No. NM_001175248.1); 1680 nt SEQ ID NO:286 Amino acid sequence of *Zea mays* INV polypeptide (Accession No. NM_001175248.1); 559aa SEQ ID NO:287 Nucleotide sequence of the protein coding region of the cDNA for *Sorghum bicolor* SUT4 gene (Sb04g038030; Accession No. XM_002453038.1); 1785 nt SEQ ID NO:288 Amino acid sequence of *Sorghum bicolor* SUT4 polypeptide (Accession No. XM_002453038.1); 594aa SEQ ID NO:289 Nucleotide sequence of the protein coding region of the cDNA for *Zea mays* SUT2 gene (Accession No. AY581895.1); 1779 nt SEQ ID NO:290 Amino acid sequence of *Zea mays* SUT2 polypeptide (Accession No. AY581895.1); 592aa SEQ ID NO:291 Nucleotide sequence of the protein coding region of the cDNA for *Arabidopsis thaliana* SWEET16 gene (Accession No. NM_001338249.1); 693 nt SEQ ID NO:292 Amino acid sequence of *Arabidopsis thaliana* SWEET16 polypeptide (Accession No. NM_001338249.1); 230aa SEQ ID NO:293 Nucleotide sequence of the protein coding region of the cDNA for *Arabidopsis thaliana* MED15-1 gene (Accession No. NM_101446.4); 4008 nt SEQ ID NO:294 Amino acid sequence of *Arabidopsis thaliana* MED15-1 polypeptide (Accession No. NM_101446.4); 1335aa SEQ ID NO:295 Nucleotide sequence of the protein coding region of the cDNA for *Zea mays* MED15-1 gene (Accession No. NM_001321633.1); 3927 nt SEQ ID NO:296 Amino acid sequence of *Zea mays* MED15-1 polypeptide (Accession No. NM_001321633.1); 1308aa SEQ ID NO:297 Nucleotide sequence of the protein coding region of the cDNA for *Arabidopsis thaliana* 14-3-3K gene (Accession No. AY079350);

SEQ ID NO:298 Amino acid sequence of *Arabidopsis thaliana* 14-3-3K polypeptide (Accession No. AY079350); 248aa SEQ ID NO:299 Nucleotide sequence of the protein coding region of the cDNA for *Sorghum bicolor* 14-3-3K gene (Accession No. XM_002445734.1); 762 nt SEQ ID NO:300 Amino acid sequence of *Sorghum bicolor* 14-3-3K polypeptide (Accession No. XM_002445734.1); 253aa SEQ ID NO:301 Nucleotide sequence of the protein coding region of the cDNA for *Arabidopsis thaliana* 14-3-3λ gene (Accession No. NM_001203346); 777 nt SEQ ID NO:302 Amino acid sequence of *Arabidopsis thaliana* 14-3-3λ polypeptide (Accession No. NM_001203346); 258aa SEQ ID NO:303 Nucleotide sequence of the protein coding region of the cDNA for *Sorghum bicolor* 14-3-3λ gene (Accession No. XM_002445734.1); 762 nt SEQ ID NO:304 Amino acid sequence of *Sorghum bicolor* 14-3-3λ polypeptide (Accession No. XM_002445734.1); 253aa SEQ ID NO:305 Amino acid sequence of *Sesamum indicum* oleosinL polypeptide (Accession No. AF091840)

SEQ ID NO:306 Amino acid sequence of *Ficus pumila* var. *awkeotsang* oleosinL ortholog polypeptide (Accession No. ABQ57397.1)

SEQ ID NO:307 Amino acid sequence of *Cucumis sativus* oleosinL ortholog polypeptide (Accession No. XP_004146901.1)

SEQ ID NO:308 Amino acid sequence of *Linum usitatissimum* oleosinL ortholog polypeptide (Accession No. ABB01618.1)

SEQ ID NO:309 Amino acid sequence of *Glycine max* oleosinL ortholog polypeptide (Accession No. XP_003556321.2)

SEQ ID NO:310 Amino acid sequence of *Ananas comosus* oleosinL ortholog polypeptide (Accession No. OAY72596.1)

SEQ ID NO:311 Amino acid sequence of *Setaria italica* oleosinL ortholog polypeptide (Accession No. XP_004956407.1)
SEQ ID NO:312 Amino acid sequence of *Fragaria vesca* subsp. *vesca* oleosinL ortholog polypeptide (Accession No. XP_004307777.1)
SEQ ID NO:313 Amino acid sequence of *Brassica napus* oleosinL ortholog polypeptide (Accession No. CDY03377.1)
SEQ ID NO:314 Amino acid sequence of *Solanum lycopersicum* oleosinL ortholog polypeptide (Accession No. XP_004240765.1)
SEQ ID NO: 315. Amino acid sequence of U1 Oleosin from *Vanilla planifolia*
SEQ ID NO: 316. Amino acid sequence of TsLDAP1 from *Triadica sebifera* (Chinese tallow)
SEQ ID NO: 317. Amino acid sequence of TsLDAP2 from *Triadica sebifera* (Chinese tallow)
SEQ ID NO: 318. Amino acid sequence of TsLDAP3 from *Triadica sebifera* (Chinese tallow)
SEQ ID NO: 319. Amino acid sequence of a GPAT9 from *Cocos nucifera* (Coconut)
SEQ ID NO: 320. Amino acid sequence of a *Zea mays* CPT1 (Accession No. NP_001151915.1)
SEQ ID NO: 321. Amino acid sequence of a *Zea mays* CPT1 (Accession No. XP_008649199.1)
SEQ ID NO: 322. Amino acid sequence of a *Sorghum bicolor* CPT1 (Accession No. XP_002451408.1)
SEQ ID NO: 323. Amino acid sequence of a *Sorghum bicolor* CPT1 (Accession No. XP_021305900.1)

DETAILED DESCRIPTION OF THE INVENTION

General Techniques

Unless specifically defined otherwise, all technical and scientific terms used herein shall be taken to have the same meaning as commonly understood by one of ordinary skill in the art (e.g., in cell culture, molecular genetics, plant biology, cell biology, protein chemistry, lipid and fatty acid chemistry, animal nutrition, biofeul production, and biochemistry).

Unless otherwise indicated, the recombinant protein, cell culture, and immunological techniques utilized in the present invention are standard procedures, well known to those skilled in the art. Such techniques are described and explained throughout the literature in sources such as, J. Perbal, A Practical Guide to Molecular Cloning, John Wiley and Sons (1984), J. Sambrook et al., Molecular Cloning: A Laboratory Manual, Cold Spring Harbour Laboratory Press (1989), T. A. Brown (editor), Essential Molecular Biology: A Practical Approach, Volumes 1 and 2, IRL Press (1991), D. M. Glover and B. D. Hames (editors), DNA Cloning: A Practical Approach, Volumes 1-4, IRL Press (1995 and 1996), F. M. Ausubel et al. (editors), Current Protocols in Molecular Biology, Greene Pub. Associates and Wiley-Interscience (1988, including all updates until present), Ed Harlow and David Lane (editors) Antibodies: A Laboratory Manual, Cold Spring Harbour Laboratory, (1988), and J. E. Coligan et al. (editors) Current Protocols in Immunology, John Wiley & Sons (including all updates until present).

Selected Definitions

The term "exogenous" in the context of a polynucleotide or polypeptide refers to the polynucleotide or polypeptide when present in a cell or a plant or part thereof which does not naturally comprise the polynucleotide or polypeptide. Such a cell is referred to herein as a "recombinant cell" or a "transgenic cell" and a plant comprising the cell as a "transgenic plant". In an embodiment, the exogenous polynucleotide or polypeptide is from a different genus to the cell of the plant or part thereof comprising the exogenous polynucleotide or polypeptide. In another embodiment, the exogenous polynucleotide or polypeptide is from a different species. In one embodiment, the exogenous polynucleotide or polypeptide expressed in the plant cell is from a different species or genus. The exogenous polynucleotide or polypeptide may be non-naturally occurring, such as for example, a synthetic DNA molecule which has been produced by recombinant DNA methods. The DNA molecule may, preferably, include a protein coding region which has been codon-optimised for expression in the plant cell, thereby producing a polypeptide which has the same amino acid sequence as a naturally occurring polypeptide, even though the nucleotide sequence of the protein coding region is non-naturally occurring. The exogenous polynucleotide may encode, or the exogenous polypeptide may be, for example: a diacylglycerol acyltransferase (DGAT) such as a DGAT1 or a DGAT2, a Wrinkled 1 (WRI1) transcription factor, on OBC such as an Oleosin or preferably an LDAP, a fatty acid thioesterase such as a FATA or FATB polypeptide, or a silencing suppressor polypeptide. In an embodiment, a cell of the invention is a recombinant cell.

As used herein, the term "triacylglycerol (TAG) content" or variations thereof refers to the amount of TAG in the cell, plant or part thereof. TAG content can be calculated using techniques known in the art such as the sum of glycerol and fatty acyl moieties using a relation: % TAG by weight=100× ((41×total mol FAME/3)+(total g FAME−(15×total mol FAME)))/g, where 41 and 15 are molecular weights of glycerol moiety and methyl group, respectively (where FAME is fatty acid methyl esters) (see Examples such as Example 1).

As used herein, the term "total fatty acid (TFA) content" or variations thereof refers to the total amount of fatty acids in the cell, plant or part thereof on a weight basis, as a percentage of the weight of the cell, plant or part thereof. Unless otherwise specified, the weight of the cell, plant or part thereof is the dry weight of the cell, plant or part thereof. TFA content is measured as described in Example 1 herein. The method involves conversion of the fatty acids in the sample to FAME and measurement of the amount of FAME by GC, using addition of a known amount of a distinctive fatty acid standard such as C17:0 as a quantitation standard in the GC. TFA therefore represents the weight of just the fatty acids, not the weight of the fatty acids and their linked moieties in the plant lipid.

As used herein, the"TAG/TFA Quotient" or "TTQ" parameter is calculated as the level of TAG (%) divided by the level of TFA (%), each as a percentage of the dry weight of the plant material. For example, a TAG level of 6% comprised in a TFA level of 10% yields a TTQ of 0.6. The TAG and TFA levels are measured as described herein. It is understood that, in this context, the TFA level refers to the weight of the total fatty acid content and the TAG level refers to the weight of TAG, including the glycerol moiety of TAG.

As used herein, the term "soluble protein content" or variations thereof refers to the amount of soluble protein in the plant or part thereof. Soluble protein content can be calculated using techniques known in the art. For instance, fresh tissue can be ground, chlorophyll and soluble sugars extracted by heating to 80° C. in 50-80% (v/v) ethanol in 2.5 mM HEPES buffer at pH 7.5, centriguation, washing pellet in distilled water, resuspending the pellet 0.1 M NaOH and heating to 95° C. for 30 min, and then the Bradford assay (Bradford, 1976) is used determined soluble protein content. Alternatively, fresh tissue can be ground in buffer containing 100 mM Tris-HCl pH 8.0 and 10 mM $MgCl_2$.

As used herein, the term "nitrogen content" or variations thereof refers to the amount of nitrogen in the plant or part thereof. Nitrogen content can be calculated using techniques known in the art. For example, freeze-dried tissue can be analysed using a Europa 20-20 isotope ratio mass spectrometer with an ANCA preparation system, comprising a combustion and reduction tube operating at 1000° C. and 600° C., respectively, to determine nitrogen content.

As used herein, the term "carbon content" or variations thereof refers to the amount of carbon in the plant or part thereof. Carbon content can be calculated using techniques known in the art. For example, organic carbon levels can be deteremined using the method described by Shaw (1959), or as described in Example 1.

As used herein, the term "carbon:nitrogen ratio" or variations thereof refers to the relative amount of carbon in the cell, plant or part thereof when compared to the amount of nitrogen in the cell, plant or part thereof. Carbon and nitrogen contents can be calculated as described above and represented as a ratio.

As used herein, the term "photosynthetic gene expression" or variations thereof refers to one or more genes expressing proteins involved in photosynthetic pathways in the plant of part thereof. Examples of photosynthetic genes which may be upregulated in plants or parts thereof of the invention include, but are not limited to, one or more of the genes listed in Table 10.

As used herein, the term "photosynthetic capacity" or variations thereof refers to the ability of the plant or part thereof to photosynthesize (convert light energy to chemical energy). Photosynthetic capacity ($A_{max}$) is a measure of the maximum rate at which leaves are able to fix carbon during photosynthesis. It is typically measured as the amount of carbon dioxide that is fixed per metre squared per second, for example as $\mu mol\ m^{-2}\ sec^{-1}$. Photosynthetic capacity can be calculated using techniques known in the art.

As used herein, the term "total dietary fibre (TDF) content" or variations thereof refers to the amount of fiber (including soluble and insoluble fibre) in the cell, plant or part thereof. As the skilled person would understand, dietary fiber includes non-starch polysaccharides such as arabinoxylans, cellulose, and many other plant components such as resistant starch, resistant dextrins, inulin, lignin, chitins, pectins, β-glucans, and oligosaccharides. TDF can be calculated using techniques known in the art. For example, using the Prosky method (Prosky et al. 1985), the McCleary method (McCleary et al., 2007) or the rapid integrated total dietary fiber method (McCleary et al., 2015).

As used herein, the term "energy content" or variations thereof refers to the amount of food energy in the plant or part thereof. More specifically, the amount of chemical energy that animals (including humans) derive from their food. Energy content can be calculated using techniques known in the art. For example, energy content can be determined based on heats of combustion in a bomb calorimeter and corrections that take into consideration the efficiency of digestion and absorption and the production of urea and other substances in the urine. As another example, energy content can be calculated as described in Example 1.

As used herein, the term "extracted lipid" refers to a composition extracted from a cell, plant or part thereof of the invention, such as a transgenic cell, plant or part thereof of the invention, which comprises at least 60% (w/w) lipid.

As used herein, the term "non-polar lipid" refers to fatty acids and derivatives thereof which are soluble in organic solvents but insoluble in water. The fatty acids may be free fatty acids and/or in an esterified form. Examples of esterified forms of non-polar lipid include, but are not limited to, triacylglycerol (TAG), diacylglycerol (DAG), monoacylglycerol (MAG). Non-polar lipids also include sterols, sterol esters and wax esters. Non-polar lipids are also known as "neutral lipids". Non-polar lipid is typically a liquid at room temperature. Preferably, the non-polar lipid predominantly (>50%) comprises fatty acids that are at least 16 carbons in length. More preferably, at least 50% of the total fatty acids in the non-polar lipid are C18 fatty acids for example, oleic acid. In an embodiment, at least 5% of the total fatty acids in the non-polar lipids are C12 or C14 fatty acids, or both. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in non-polar lipid of the invention are present as TAG. The non-polar lipid may be further purified or treated, for example by hydrolysis with a strong base to release the free fatty acid, or by fractionation, distillation, or the like. Non-polar lipid may be present in or obtained from plant parts such as seed, leaves, tubers, beets or fruit. Non-polar lipid of the invention may form part of "seedoil" if it is obtained from seed.

The free and esterified sterol (for example, sitosterol, campesterol, stigmasterol, brassicasterol, Δ5-avenasterol, sitostanol, campestanol, and cholesterol) concentrations in the extracted lipid may be as described in Phillips et al. (2002). Sterols in plant oils are present as free alcohols, esters with fatty acids (esterified sterols), glycosides and acylated glycosides of sterols. Sterol concentrations in naturally occurring vegetable oils (seedoils) ranges up to a maximum of about 1100 mg/100 g. Hydrogenated palm oil has one of the lowest concentrations of naturally occurring vegetable oils at about 60 mg/100 g. The recovered or extracted seedoils of the invention preferably have between about 100 and about 1000 mg total sterol/100 g of oil. For use as food or feed, it is preferred that sterols are present primarily as free or esterified forms rather than glycosylated forms. In the seedoils of the present invention, preferably at least 50% of the sterols in the oils are present as esterified sterols, except for soybean seedoil which has about 25% of the sterols esterified. The canola seedoil and rapeseed oil of the invention preferably have between about 500 and about 800 mg total sterol/100 g, with sitosterol the main sterol and campesterol the next most abundant. The corn seedoil of the invention preferably has between about 600 and about 800 mg total sterol/100 g, with sitosterol the main sterol. The soybean seedoil of the invention preferably has between about 150 and about 350 mg total sterol/100 g, with sitosterol the main sterol and stigmasterol the next most abundant, and with more free sterol than esterified sterol. The cottonseed oil of the invention preferably has between about 200 and about 350 mg total sterol/100 g, with sitosterol the main sterol. The coconut oil and palm oil of the invention preferably have between about 50 and about 100 mg total sterol/100 g, with sitosterol the main sterol. The safflower seedoil of the invention preferably has between about 150 and about 250 mg total sterol/100 g, with sitosterol the main sterol. The peanut seedoil of the invention preferably has between about 100 and about 200 mg total sterol/100 g, with sitosterol the main sterol. The sesame seedoil of the invention preferably has between about 400 and about 600 mg total sterol/100 g, with sitosterol the main sterol. The sunflower seedoil of the invention preferably has between about 200 and 400 mg total sterol/100 g, with sitosterol the main sterol. Oils obtained from vegetative plant parts according to the invention preferably have less than 200 mg total sterol/100 g, more preferably less than 100 mg total sterol/100 g, and most preferably less than 50 mg total sterols/100 g, with the majority of the sterols being free sterols.

As used herein, the term "vegetative oil" refers to a composition obtained from vegetative parts of a plant which comprises at least 60% (w/w) lipid, or obtainable from the vegetative parts if the oil is still present in the vegetative part. That is, vegetative oil of the invention includes oil which is present in the vegetative plant part, as well as oil which has been extracted from the vegetative part (extracted oil). The vegetative oil is preferably extracted vegetative oil. Vegetative oil is typically a liquid at room temperature. Preferably, the total fatty acid (TFA) content in the vegetative oil predominantly (>50%) comprises fatty acids that are at least 16 carbons in length. More preferably, at least 50% of the total fatty acids in the vegetative oil are C18 fatty acids for example, oleic acid. The fatty acids are typically in an esterified form such as for example, TAG, DAG, acyl-CoA, galactolipid or phospholipid. The fatty acids may be free fatty acids and/or in an esterified form. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in vegetative oil of the invention can be found as TAG. In an embodiment, vegetative oil of the invention is "substantially purified" or "purified" oil that has been separated from one or more other lipids, nucleic acids, polypeptides, or other contaminating molecules with which it is associated in the vegetative plant part or in a crude extract. It is preferred that the substantially purified vegetative oil is at least 60% free, more preferably at least 75% free, and more preferably, at least 90% free from other components with which it is associated in the vegetative plant part or extract. Vegetative oil of the invention may further comprise non-fatty acid molecules such as, but not limited to, sterols. In an embodiment, the vegetative oil is canola oil (*Brassica* sp. such as *Brassica carinata, Brassica juncea, Brassica napobrassica, Brassica napus*) mustard oil (*Brassica juncea*), other *Brassica* oil (e.g., *Brassica napobrassica, Brassica camelina*), sunflower oil (*Helianthus* sp. such as *Helianthus annuus*), linseed oil (*Linum usitatissimum*), soybean oil (*Glycine max*), safflower oil (*Carthamus tinctorius*), corn oil (*Zea mays*), tobacco oil (*Nicotiana* sp. such as *Nicotiana tabacum* or *Nicotiana benthamiana*), peanut oil (*Arachis hypogaea*), palm oil (*Elaeis guineensis*), cotton oil (*Gossypium hirsutum*), coconut oil (*Cocos nucifera*), avocado oil (*Persea americana*), olive oil (*Olea europaea*), cashew oil (*Anacardium occidentale*), macadamia oil (*Macadamia intergrifolia*), almond oil (*Prunus amygdalus*), oat oil (*Avena sativa*), rice oil (*Oryza* sp. such as *Oryza sativa* and *Oryza glaberrima*), Arabidopsis oil (*Arabidopsis thaliana*), *Aracinis hypogaea* (peanut), *Beta vulgaris* (sugar beet), *Camelina sativa* (false flax), *Crambe abyssinica* (Abyssinian kale), *Cucumis melo* (melon), *Hordeum vulgare* (barley), *Jatropha curcas* (physic nut), *Joannesia princeps* (arara nut-tree), *Licania rigida* (oiticica), *Lupinus angustifolius* (lupin), *Miscanthus* sp. such as *Miscanthus* x *giganteus* and *Miscanthus sinensis, Panicum virgatum* (switchgrass), *Pongamia pinnata* (Indian beech), *Populus trichocarpa, Ricinus communis* (castor), *Saccharum* sp. (sugarcane), *Sesamum indicum* (sesame), *Solanum tuberosum* (potato), *Sorghum* sp. such as *Sorghum bicolor, Sorghum vulgare, Theobroma grandiforum* (cupuassu), *Trifolium* sp., and *Triticum* sp. (wheat) such as *Triticum aestivum*. Vegetative oil may be extracted from vegetative plant parts by any method known in the art, such as for extracting seedoils. This typically involves extraction with nonpolar solvents such as diethyl ether, petroleum ether, chloroform/methanol or butanol mixtures, generally associated with first crushing of the seeds. Lipids associated with the starch or other polysaccharides may be extracted with water-saturated butanol. The seedoil may be "degummed" by methods known in the art to remove polar lipids such as phospholipids or treated in other ways to remove contaminants or improve purity, stability, or colour. The TAGs and other esters in the vegetative oil may be hydrolysed to release free fatty acids, or the oil hydrogenated, treated chemically, or enzymatically as known in the art. As used herein, the term "seedoil" has an analogous meaning except that it refers to a lipid composition obtained from seeds of plants of the invention.

As used herein, the term "fatty acid" refers to a carboxylic acid with an aliphatic tail of at least 8 carbon atoms in length, either saturated or unsaturated. Preferred fatty acids have a carbon-carbon bonded chain of at least 12 carbons in length. Most naturally occurring fatty acids have an even number of carbon atoms because their biosynthesis involves acetate which has two carbon atoms. The fatty acids may be in a free state (non-esterified) or in an esterified form such as part of a TAG, DAG, MAG, acyl-CoA (thio-ester) bound, acyl-ACP bound, or other covalently bound form. When covalently bound in an esterified form, the fatty acid is referred to herein as an "acyl" group. The fatty acid may be esterified as a phospholipid such as a phosphatidylcholine (PC), phosphatidylethanolamine (PE), phosphatidylserine (PS), phosphatidylglycerol (PG), phosphatidylinositol (PI), or diphosphatidylglycerol. Saturated fatty acids do not contain any double bonds or other functional groups along the chain. The term "saturated" refers to hydrogen, in that all carbons (apart from the carboxylic acid [—COOH] group) contain as many hydrogens as possible. In other words, the omega (ω) end contains 3 hydrogens ($CH_3$—) and each carbon within the chain contains 2 hydrogens (—$CH_2$—). Unsaturated fatty acids are of similar form to saturated fatty acids, except that one or more alkene functional groups exist along the chain, with each alkene substituting a singly-bonded "—$CH_2$—$CH_2$—" part of the chain with a doubly-bonded "—CH═CH—" portion (that is, a carbon double bonded to another carbon). The two next carbon atoms in the chain that are bound to either side of the double bond can occur in a cis or trans configuration.

As used herein, the terms "monounsaturated fatty acid" or "MUFA" refer to a fatty acid which comprises at least 12 carbon atoms in its carbon chain and only one alkene group (carbon-carbon double bond), which may be in an esterified or non-esterified (free) form. As used herein, the terms "polyunsaturated fatty acid" or "PUFA" refer to a fatty acid which comprises at least 12 carbon atoms in its carbon chain and at least two alkene groups (carbon-carbon double bonds), which may be in an esterified or non-esterified form.

"Monoacylglyceride" or "MAG" is glyceride in which the glycerol is esterified with one fatty acid. As used herein, MAG comprises a hydroxyl group at an sn-1/3 (also referred to herein as sn-1 MAG or 1-MAG or 1/3-MAG) or sn-2 position (also referred to herein as 2-MAG), and therefore MAG does not include phosphorylated molecules such as PA or PC. MAG is thus a component of neutral lipids in a plant or part thereof.

"Diacylglyceride" or "DAG" is glyceride in which the glycerol is esterified with two fatty acids which may be the same or, preferably, different. As used herein, DAG comprises a hydroxyl group at a sn-1,3 or sn-2 position, and therefore DAG does not include phosphorylated molecules such as PA or PC. DAG is thus a component of neutral lipids in a plant or part thereof. In the Kennedy pathway of DAG synthesis (FIG. 1), the precursor sn-glycerol-3-phosphate (G3P) is esterified to two acyl groups, each coming from a fatty acid coenzyme A ester, in a first reaction catalysed by a glycerol-3-phosphate acyltransferase (GPAT) at position sn-1 to form LysoPA, followed by a second acylation at position sn-2 catalysed by a lysophosphatidic acid acyltransferase (LPAAT) to form phosphatidic acid (PA). This intermediate is then de-phosphorylated by PAP to form DAG. DAG may also be formed from TAG by removal of an acyl group by a lipase, or from PC essentially by removal of a choline headgroup by any of the enzymes PDCT, PLC or PLD (FIG. 1).

"Triacylglyceride" or "TAG" is a glyceride in which the glycerol is esterified with three fatty acids which may be the same (e.g. as in tri-olein) or, more commonly, different. In the Kennedy pathway of TAG synthesis, DAG is formed as described above, and then a third acyl group is esterified to the glycerol backbone by the activity of DGAT. Alternative pathways for formation of TAG include one catalysed by the enzyme PDAT (FIG. 1) and the MGAT pathway described herein.

As used herein, the term "wild-type" or variations thereof refers to cell, plant or part thereof such as a cell, vegetative plant part, seed, tuber or beet, that has not been genetically modified, such as cells, plants or parts thereof that do not comprise the first and second exogenous polynucleotides, according to this invention.

The term "corresponding" refers to a cell, plant or part thereof such as a cell, vegetative plant part, seed, tuber or beet, that has the same or similar genetic background as a cell, plant or part thereof such as a vegetative plant part, seed, tuber or beet of the invention but which has not been modified as described herein (for example, a vegetative plant part or seed which lacks the first and second exogenous polynucleotides). In a preferred embodiment, the corresponding plant or part thereof such as a vegetative plant part is at the same developmental stage as the plant or part thereof such as a vegetative plant part of the invention. For example, if the plant is a flowering plant, then preferably the corresponding plant is also flowering. A corresponding cell, plant or part thereof such as a vegetative plant part, can be used as a control to compare levels of nucleic acid or protein expression, or the extent and nature of trait modification, for example TTQ and/or TAG content, with the cell, plant or part thereof such as a vegetative plant part of the invention which is modified as described herein. A person skilled in the art is readily able to determine an appropriate "corresponding" cell, plant or part thereof such as a vegetative plant part for such a comparison.

As used herein, "compared with" or "relative to" refers to comparing levels of, for example, TTQ or triacylglycerol (TAG) content, one or more or all of soluble protein content, nitrogen content, carbon:nitrogen ratio, photosynthetic gene expression, photosynthetic capacity, total dietary fibre (TDF) content, carbon content, and energy content, or non-polar lipid content or composition, total non-polar lipid content, total fatty acid content or other parameter of the cell, plant or part thereof comprising the one or more exogenous polynucleotides, genetic modifications or exogenous polypeptides with a cell, plant or part thereof such as a vegetative plant part lacking the one or more exogenous polynucelotides, genetic modifications or polypeptides.

As used herein, "synergism", "synergistic", "acting synergistically" and related terms are each a comparative term that means that the effect of a combination of elements present in a plant or part thereof of the invention, for example a combination of elements A and B, is greater than the sum of the effects of the elements separately in corresponding plants or parts thereof, for example the sum of the effect of A and the effect of B. Where more than two elements are present in the plant or part thereof, for example elements A, B and C, it means that the effect of the combination of all of the elements is greater than the sum of the effects of the individual effects of the elements. In a preferred embodiment, it means that the effect of the combination of elements A, B and C is greater than the sum of the effect of elements A and B combined and the effect of element C. In such a case, it can be said that element C acts synergistically with elements A and B. As would be understood, the effects are measured in corresponding cells, plants or parts thereof, for example grown under the same conditions and at the same stage of biological development.

As used herein, "germinate at a rate substantially the same as for a corresponding wild-type plant" or similar phrases refers to seed of a plant of the invention being relatively able to germinate when compared to seed of a wild-type plant lacking the defined exogenous polynucleotide(s) and genetic modifications. Germination may be measured in vitro on tissue culture medium or in soil as occurs in the field. In one embodiment, the number of seeds which germinate, for instance when grown under optimal greenhouse conditions for the plant species, is at least 75%, more preferably at least 90%, when compared to corresponding wild-type seed. In another embodiment, the seeds which germinate, for instance when grown under optimal glasshouse conditions for the plant species, produce seedlings which grow at a rate which, on average, is at least 75%, more preferably at least 90%, when compared to corresponding wild-type plants. This is referred to as "seedling vigour". In an embodiment, the rate of initial root growth and shoot growth of seedlings of the invention is essentially the same compared to a corresponding wild-type seedling grown under the same conditions. In an embodiment, the leaf biomass (dry weight) of the plants of the invention is at least 80%, preferably at least 90%, of the leaf biomass relative to a corresponding wild-type plant grown under the same conditions, preferably in the field. In an embodiment, the height of the plants of the invention is at least 70%, preferably at least 80%, more preferably at least 90%, of the plant height relative to a corresponding wild-type plant grown under the same conditions, preferably in the field and preferably at maturity.

As used herein, the term "an exogenous polynucleotide which down-regulates the production and/or activity of an endogenous polypeptide" or variations thereof, refers to a polynucleotide that encodes an RNA molecule, herein termed a "silencing RNA molecule" or variations thereof (for example, encoding an amiRNA or hpRNAi), that down-regulates the production and/or activity, or itself down-regulates the production and/or activity (for example, is an amiRNA or hpRNA which can be delivered directly to, for example, the plant or part thereof) of an endogenous polypeptide. This includes where the initial RNA transcript produced by expression of the exogenous polynucleotide is processed in the cell to form the actual silencing RNA molecule. The endogenous polypeptides whose production or activity are downregulated include, for example, SDP1 TAG lipase, plastidial GPAT, plastidial LPAAT, TGD polypeptide such as TGD5, TST such as TST1 or TST2, AGPase, PDCT, CPT or Δ12 fatty acid desturase (FAD2), or a combination of two or more thereof. Typically, the RNA molecule decreases the expression of an endogenous gene encoding the polypeptide. The extent of down-regulation is typically less than 100%, for example the production or activity is reduced by between 25% and 95% relative to the wild-type. The optimal level of remaining production or activity can be routinely determined.

As used herein, the term "on a weight basis" refers to the weight of a substance (for example, TAG, DAG, fatty acid, protein, nitrogen, carbon) as a percentage of the weight of the composition comprising the substance (for example, seed, leaf dry weight). For example, if a transgenic seed has 25 μg total fatty acid per 120 μg seed weight; the percentage of total fatty acid on a weight basis is 20.8%.

As used herein, the term "on a relative basis" refers to a parameter such as the amount of a substance in a composition comprising the substance in comparison with the parameter for a corresponding composition, as a percentage. For example, a reduction from 3 units to 2 units is a reduction of 33% on a relative basis.

As used herein, "plastids" are organelles in plants, including algae, which are the site of manufacture of carbon-based compounds from photosynthesis including sugars, starch and fatty acids. Plastids include chloroplasts which contain chlorophyll and carry out photosynthesis, etioplasts which are the predecessors of chloroplasts, as well as specialised plastids such as chromoplasts which are coloured plastids for synthesis and storage of pigments, gerontoplasts which control the dismantling of the photosynthetic apparatus during senescence, amyloplasts for starch synthesis and storage, elaioplasts for storage of lipids, and proteinoplasts for storing and modifying proteins.

As used herein, the term "biofuel" refers to any type of fuel, typically as used to power machinery such as automobiles, planes, boats, trucks or petroleum powered motors, whose energy is derived from biological carbon fixation. Biofuels include fuels derived from biomass conversion, as well as solid biomass, liquid fuels and biogases. Examples of biofuels include bioalcohols, biodiesel, synthetic diesel, vegetable oil, bioethers, biogas, syngas, solid biofuels, algae-derived fuel, biohydrogen, biomethanol, 2,5-Dimethylfuran (DMF), biodimethyl ether (bioDME), Fischer-Tropsch diesel, biohydrogen diesel, mixed alcohols and wood diesel.

As used herein, the term "bioalcohol" refers to biologically produced alcohols, for example, ethanol, propanol and butanol. Bioalcohols are produced by the action of microorganisms and/or enzymes through the fermentation of sugars, hemicellulose or cellulose.

As used herein, the term "biodiesel" refers to a composition comprising fatty acid methyl- or ethyl-esters derived from lipids by transesterification, the lipids being from living cells not fossil fuels.

As used herein, the term "synthetic diesel" refers to a form of diesel fuel which is derived from renewable feedstock rather than the fossil feedstock used in most diesel fuels.

As used herein, the term "vegetable oil" includes a pure plant oil (or straight vegetable oil) or a waste vegetable oil (by product of other industries), including oil produced in either a vegetative plant part or in seed. Vegetable oil includes vegetative oil and seedoil, as defined herein.

As used herein, the term "biogas" refers to methane or a flammable mixture of methane and other gases produced by anaerobic digestion of organic material by anaerobes.

As used herein, the term "syngas" refers to a gas mixture that contains varying amounts of carbon monoxide and hydrogen and possibly other hydrocarbons, produced by partial combustion of biomass. Syngas may be converted into methanol in the presence of catalyst (usually copper-based), with subsequent methanol dehydration in the presence of a different catalyst (for example, silica-alumina).

As used herein, the term "biochar" refers to charcoal made from biomass, for example, by pyrolysis of the biomass.

As used herein, the term "feedstock" refers to a material, for example, biomass or a conversion product thereof (for example, syngas) when used to produce a product, for example, a biofuel such as biodiesel or a synthetic diesel.

As used herein, the term "industrial product" refers to a hydrocarbon product which is predominantly made of carbon and hydrogen such as, for example, fatty acid methyl- and/or ethyl-esters or alkanes such as methane, mixtures of longer chain alkanes which are typically liquids at ambient temperatures, a biofuel, carbon monoxide and/or hydrogen, or a bioalcohol such as ethanol, propanol, or butanol, or biochar. The term "industrial product" is intended to include intermediary products that can be converted to other industrial products, for example, syngas is itself considered to be an industrial product which can be used to synthesize a hydrocarbon product which is also considered to be an industrial product. The term industrial product as used herein includes both pure forms of the above compounds, or more commonly a mixture of various compounds and components, for example the hydrocarbon product may contain a range of carbon chain lengths, as well understood in the art.

As used herein, "progeny" means the immediate and all subsequent generations of offspring produced from a parent, for example a second, third or later generation offspring.

As used herein, the term "ancestor" refers to any earlier generation of the plant comprising the first and second exogenous polynucleotides. The ancestor may be the parent plant, grandparent plant, great grandparent plant and so on.

As used herein, the term "selecting a plant" means actively selecting the plant on the basis that it has the desired phenotype, such as increased TTQ, increased TAG and protein content when compared to the corresponding wild-type plant.

As used herein, phrases such as "comprise a TFA content of about 5% (w/w dry weight)", or "comprise a total TAG content of about 6% (w/w dry weight)", or similarly structured phrases, mean that more than the defined level may be present. For instance, the phrase "comprise a TFA content of about 5% (w/w dry weight)" can be used interchangeably with "comprises at least about 5% TFA (w/w dry weight)". Extending this example further, a vegetative plant part which comprise a TFA content of about 5% (w/w dry weight) may have a 6%, or 7.5% or higher TFA content.

As used herein, unless the context indicates otherwise, the term "increased content" when used in reference to a polypeptide, or similar pharses including refrence to specific polypeptide, refers to either an exogenous polypeptide or an endogenous polypeptide. For example, a vegetative plant part of the invention may comprise an increased content of a WRI1 polypeptide, an increased content of a DGAT polypeptide, and a decreased content of a SDP1 polypeptide, each relative to a corresponding wild-type vegetative plant part, wherein each of the WRI1 and DGAT polypeptides is independently either an exogenous polypeptide or an endogenous polypeptide. As another example, a vegetative plant part of the invention may comprise an increased content of a WRI1 polypeptide, an increased content of a DGAT polypeptide, and an increased content of a LEC2 polypeptide, each relative to a corresponding wild-type vegetative plant part, wherein each of the WRI1, DGAT and LEC2 polypeptides is independently either an exogenous polypeptide or an endogenous polypeptide. As a further example, a vegetative plant part of the invention may comprise an increased content of a PDAT or DGAT polypeptide, a decreased content of a TGD polypeptide, and a decreased content of a SDP1 polypeptide, each relative to a corresponding wild-type vegetative plant part wherein the PDAT or DGAT is either an exogenous polypeptide or an endogenous polypeptide, and so on. An exogenous polypepetide may be the result of expression of a transgene encoding the polypeptide in the cell or plant or part thereof of the invention. The endogenous polypeptide may be the result of increased expression of an endogenous gene, such as inducing overexpression and/or providing increased levels of a transcription factor(s) for the gene.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

The term "and/or", e.g., "X and/or Y" shall be understood to mean either "X and Y" or "X or Y" and shall be taken to provide explicit support for both meanings or for either meaning.

As used herein, the term about, unless stated to the contrary, refers to +/−10%, more preferably +/−5%, more preferably +/−2%, more preferably +/−1%, even more preferably +/−0.5%, of the designated value.

Production of Plants with Modified Traits

The present invention is based on the finding that plant traits, such two or more of non-polar lipid content, protein content, TTQ, TAG content, nitrogen content, carbon content, in plants or parts thereof can be increased by a combination of modifications selected from those designated herein as: (A). Push, (B). Pull, (C). Protect, (D). Package, (E). Plastidial Export, (F). Plastidial Import and (G). Prokaryotic Pathway.

Plants or parts thereof such as a vegetative plant parts of the invention therefore have a number of combinations of exogenous polynucleotides and/or genetic modifications each of which provide for one of the modifications. These exogenous polynucleotides and/or genetic modifications include:

(A) an exogenous polynucleotide which encodes a transcription factor polypeptide that increases the expression of one or more glycolytic and/or fatty acid biosynthetic genes in the plant or part thereof such as a vegetative plant part, providing the "Push" modification, (B) an exogenous polynucleotide which encodes a polypeptide involved in the biosynthesis of one or more non-polar lipids in the plant or part thereof such as a vegetative plant part, providing the "Pull" modification, (C) a genetic modification which down-regulates endogenous production and/or activity of a polypeptide involved in the catabolism of triacylglycerols (TAG) in the plant or part thereof such as a vegetative plant part when compared to a corresponding plant or part thereof such as a vegetative plant part lacking the genetic modification, providing the "Protect" modification, (D) an exogenous polynucleotide which encodes an oil body coating (OBC) polypeptide such as a lipid droplet associated polypeptide (LDAP), providing the "Package" modification, (E) an exogenous polynucleotide which encodes a polypeptide which increases the export of fatty acids out of plastids of the plant or part thereof such as a vegetative plant part, when compared to a corresponding plant or part thereof such as a vegetative plant part lacking the exogenous polynucleotide, providing the "Plastidial Export" modification, (F) a genetic modification which down-regulates endogenous production and/or activity of a polypeptide involved in importing fatty acids into plastids of the plant or part thereof such as a vegetative plant part when compared to a corresponding plant or part thereof such as a vegetative plant part lacking the genetic modification, providing the "Plastidial Import" modification, and G) a genetic modification which down-regulates endogenous production and/or activity of a polypeptide involved in diacylglycerol (DAG) production in the plastid of the plant or part thereof such as a vegetative plant part when compared to a corresponding plant or part thereof such as a vegetative plant part lacking the genetic modification, providing the "prokaryotic Pathway" modification.

Preferred combinations (also referred to herein as sets) of exogenous polynucleotides and/or genetic modifications of the invention are;

1) A, B and optionally one of C, D, E, F or G;
2) A, C and optionally one of D, E, F or G;
3) A, D and optionally one of E, F or G;
4) A, E and optionally F or G;
5) A, F and optionally G;
6) A and G;
7) A, B, C and optionally one of D, E, F or G;
8) A, B, D and optionally one of E, F or G;
9) A, B, E and optionally F or G;
10) A, B, F and optionally G;
11) A, B, C, D and optionally one of E, F or G;
12) A, B, C, E and optionally F or G;
13) A, B, C, F and optionally G;
14) A, B, D, E and optionally F or G;
15) A, B, D, F and optionally G;
16) A, B, E, F and optionally G;
17) A, C, D and optionally one of E, F or G;
18) A, C, E and optionally F or G;
19) A, C, F and optionally G;
20) A, C, D, E and optionally F or G;
21) A, C, D, F and optionally G;
22) A, C, E, F and optionally a fifth modification G;
23) A, D, E and optionally F or G;
24) A, D, F and optionally G;
25) A, D, E, F and optionally G;
26) A, E, F and optionally G;
27) Six of A, B, C, D, E, F and G omitting one of A, B, C, D, E, F or G, and
28) Any one of 1-26 above where there are two or more exogenous polynucleotides encoding two or more different transcription factor polypeptides that increases the expression of one or more glycolytic and/or fatty acid biosynthetic genes in the plant or part thereof, for example one exogenous polynucleotide encoding WRI1 and another exogenous polynucleotide encoding LEC2.

In each of the above preferred combinations there may be at least two different exogenous polynucleotides which encode at least two different transcription factor polypeptides that increases the expression of one or more glycolytic and/or fatty acid biosynthetic genes in the plant or part thereof such as a vegetative plant part.

These modifications are described more fully as follows:

A. The "Push" modification is characterised by an increased synthesis of total fatty acids in the plastids of the plant or part thereof. In an embodiment, this occurs by the increased expression and/or activity of a transcription factor which regulates fatty acid synthesis in the plastids. In one embodiment, this can be achieved by expressing in a transgenic plant or part thereof an exogenous polynucleotide which encodes a transcription factor polypeptide that increases the expression of one or more glycolytic and/or fatty acid biosynthetic genes in the plant or part thereof. In an embodiment, the increased fatty acid synthesis is not caused by the provision to the plant or part thereof of an altered ACCase whose activity is less inhibited by fatty acids, relative to the endogenous ACCase in the plant or part thereof. In an embodiment, the plant or part thereof comprises an exogenous polynucleotide which encodes the transcription factor, preferably under the control of a promoter other than a constitutive promoter. The transcription factor may be selected from the group consisting of WRI1, LEC1, LEC1-like, LEC2, BBM, FUS3, ABI3, ABI4, ABI5, Dof4, Dof11 or the group consisting of MYB73, bZIP53, AGL15, MYB115, MYB118, TANMEI, WUS, GFR2a1, GFR2a2 and PHR1, and is preferably WRI1, LEC1 or LEC2. In a further embodiment, the increased synthesis of total fatty acids is relative to a corresponding wild-type plant or part thereof. In an embodiment, there are two or more exogenous polynucleotides encoding two or more different transcription factor polypeptides. The "Push" modification may also be achieved by increased expression of polypeptides which modulate activity of WRI1, such as MED15 or 14-3-3 polypeptides.

B. The "Pull" modification is characterised by increased expression and/or activity in the plant or part thereof of a fatty acyl acyltransferase which catalyses the synthesis of TAG, DAG or MAG in the plant or part thereof, such as a DGAT, PDAT, LPAAT, GPAT or MGAT, preferably a DGAT or a PDAT. In one embodiment, this can be achieved by expressing in a transgenic plant or part thereof an exogenous polynucleotide which encodes a polypeptide involved in the biosynthesis of one or more non-polar lipids. In an embodiment, the acyltransferase is a membrane-bound acyltransferase that uses an acyl-CoA substrate as the acyl donor in the case of DGAT, LPAAT, GPAT or MGAT, or an acyl group from PC as the acyl donor in the case of PDAT. The Pull modification can be relative to a corresponding wild-type plant or part thereof or, preferably, relative to a corresponding plant or part thereof which has the Push modification. In an embodiment, the plant or part thereof comprises an exogenous polynucleotide which encodes the fatty acyl acyltransferase. The "Pull" modification can also be achieved by increased expression of a PDCT, CPT or phospholipase C or D polypeptide which increases the production of DAG from PC.

C. The "Protect" modification is characterised by a reduction in the catabolism of triacylglycerols (TAG) in the plant or part thereof. In an embodiment, this can be achieved through a genetic modification in the plant or part thereof which down-regulates endogenous production and/or activity of a polypeptide involved in the catabolism of triacylglycerols (TAG) in the plant or part thereof when compared to a corresponding plant or part thereof lacking the genetic modification. In an embodiment, the plant or part thereof has a reduced expression and/or activity of an endogenous TAG lipase in the plant or part thereof, preferably an SDP1 lipase, a Cgi58 polypeptide, an acyl-CoA oxidase such as the ACX1 or ACX2, or a polypeptide involved in β-oxidation of fatty acids in the plant or part thereof such as a PXA1 peroxisomal ATP-binding cassette transporter. This may occur by expression in the plant or part thereof of an exogenous polynucleotide which encodes an RNA molecule which reduces the expression of, for example, an endogenous gene encoding the TAG lipase such as the SDP1 lipase, acyl-CoA oxidase or the polypeptide involved in (3-oxidation of fatty acids in the plant or part thereof, or by a mutation in an endogenous gene encoding, for example, the TAG lipase, acyl-CoA oxidase or polypeptide involved in β-oxidation of fatty acids. In an embodiment, the reduced expression and/or activity is relative to a corresponding wild-type plant or part thereof or relative to a corresponding plant or part thereof which has the Push modification.

D. The "Package" modification is characterised by an increased expression and/or accumulation of an oil body coating (OBC) polypeptide. In an embodiment, this can be achieved by expressing in a transgenic plant or part thereof an exogenous polynucleotide which encodes an oil body coating (OBC) polypeptide. The OBC polypeptide may be an oleosin, such as for example a polyoleosin, a caoleosin or a steroleosin, or preferably an LDAP. In an embodiment, the level of oleosin that is accumulated in the plant or part thereof is at least 2-fold higher relative to the corresponding plant or part thereof comprising the oleosin gene from the T-DNA of pJP3502. In an embodiment, the increased expression or accumulation of the OBC polypeptide is not caused solely by the Push modification. In an embodiment, the expression and/or accumulation is relative to a corresponding wild-type plant or part thereof or, preferably, relative to a corresponding plant or part thereof which has the Push modification.

E. The "Plastidial Export" modification is characterised by an increased rate of export of total fatty acids out of the plastids of the plant or part thereof. In one embodiment, this can be achieved by expressing in a plant or part thereof an exogenous polynucleotide which encodes a polypeptide which increases the export of fatty acids out of plastids of the plant or part thereof when compared to a corresponding plant or part thereof lacking the exogenous polynucleotide. In an embodiment, this occurs by the increased expression and/or activity of a fatty acid thioesterase (TE), a fatty acid transporter polypeptide such as an ABCA9 polypeptide, or a long-chain acyl-CoA synthetase (LACS). In an embodiment, the plant or part thereof comprises an exogenous polynucleotide which encodes the TE, fatty acid transporter polypeptide or LACS. The TE may be a FATB polypeptide or preferably a FATA polypeptide. In an embodiment, the Plastidial Export modification is relative to a corresponding wild-type plant or part thereof or, preferably, relative to a corresponding plant or part thereof which has the Push modification.

F. The "Plastidial Import" modification is characterised by a reduced rate of import of fatty acids into the plastids of the plant or part thereof from outside of the plastids. In an embodiment, this can be achieved through a genetic modification in the plant or part thereof which down-regulates endogenous production and/or activity of a polypeptide involved in importing fatty acids into plastids of the plant or part thereof when compared to a corresponding plant or part thereof lacking the genetic modification. For example, this may occur by expression in the plant or part thereof of an exogenous polynucleotide which encodes an RNA molecule which reduces the expression of an endogenous gene encoding an transporter polypeptide such as a TGD polypeptide, for example a TGD1, TGD2, TGD3, TGD4 or preferably a TGD5 polypeptide, or by a mutation in an endogenous gene encoding the TGD polypeptide. In an embodiment, the reduced rate of import is relative to a corresponding wild-type plant or part thereof or relative to a corresponding plant or part thereof which has the Push modification.

G. The "Prokaryotic Pathway" modification is characterised by a decreased amount of DAG or rate of production of DAG in the plastids of the plant or part thereof. In an embodiment, this can be achieved through a genetic modification in the plant or part thereof which down-regulates endogenous production and/or activity of a polypeptide involved in diacylglycerol (DAG) production in the plastid when compared to a corresponding plant or part thereof lacking the genetic modification. In an embodiment, the decreased amount or rate of production of DAG occurs by a decreased production of LPA from acyl-ACP and G3P in the plastids. The decreased amount or rate of production of DAG may occur by expression in the plant or part thereof of an exogenous polynucleotide which encodes an RNA molecule which reduces the expression of an endogenous gene encoding a plastidial GPAT, plastidial LPAAT or a plastidial PAP, preferably a plastidial GPAT, or by a mutation in an endogenous gene encoding the plastidial polypeptide. In an embodiment, the decreased amount or rate of production of DAG is relative to a corresponding wild-type plant or part thereof or, preferably, relative to a corresponding plant or part thereof which has the Push modification.

The Push modification is highly desirable in the invention, and the Pull modification is preferred. The Protect and Package modifications may be complementary i.e. one of the two may be sufficient. The plant or part thereof may comprise one, two or all three of the Plastidial Export, Plastidial Import and Prokaryotic Pathway modifications. In an embodiment, at least one of the exogenous polynucleotides in the plant or part thereof, preferably at least the exogenous polynucleotide encoding the transcription factor which regulates fatty acid synthesis in the plastids, is expressed under the control of (H) a promoter other than a constitutive promoter such as, for example, a developmentally related promoter, a promoter that is preferentially active in photosynthetic cells, a tissue-specific promoter, a promoter which has been modified by reducing its expression level relative to a corresponding native promoter, or is preferably a senesence-specific promoter. More preferably, at least the exogenous polynucleotide encoding the transcription factor which regulates fatty acid synthesis in the plastids is expressed under the control of a promoter other than a constitutive promoter and the exogenous polynucleotide which encodes an RNA molecule which down-regulates endogenous production and/or activity of a polypeptide involved in the catabolism of triacylglycerols is also expressed under the control of a promoter other than a constitutive promoter, which promoters may be the same or different. Alternatively in monocotyledonous plants, the exogenous polynucleotide encoding the transcription factor which regulates fatty acid synthesis in the plastids is expressed under the control of a constitutive promoter such as, for example, a ubiquitin gene promoter or an actin gene promoter.

Plants produce some, but not all, of their membrane lipids such as MGDG in plastids by the so-called prokaryotic pathway (FIG. 1). In plants, there is also a eukaryotic pathway for synthesis of galactolipids and glycerolipids which synthesizes FA first of all in the plastid and then assembles the FA into glycerolipids in the ER. MGDG synthesised by the eukaryotic pathway contains C18:3 (ALA) fatty acid esterified at the sn-2 position of MGDG. The DAG backbone including the ALA for the MGDG synthesis by this pathway is assembled in the ER and then imported into the plastid. In contrast, the MGDG synthesized by the prokaryotic pathway contains C16:3 fatty acid esterified at the sn-2 position of MGDG. The ratio of the contribution of the prokaryotic pathway relative to the eukaryotic pathway in producing MGDG (16:3) vs MGDG (18:3) is a characteristic and distinctive feature of different plant species (Mongrand et al. 1998). This distinctive fatty acid composition of MGDG allows all higher plants (angiosperms) to be classified as either so-called 16:3 or 18:3 plants. 16:3 species, exemplified by *Arabidopsis* and *Brassica napus*, generally have both of the prokaryotic and eukaryotic pathways of MGDG synthesis operating, whereas the 18:3 species exemplified by *Sorghum bicolor, Zea mays, Nicotiana tabacum, Pisum sativum* and *Glycine max* generally have only (or almost entirely) the eukaryotic pathway of MGDG synthesis, providing little or no C16:3 fatty acid accumulation in the vegetative tissues. As used herein, a "16:3 plant" or "16:3 species" is one which has more than 2% C16:3 fatty acid in the total fatty acid content of its photosynthetic tissues. As used herein, a "18:3 plant" or "18:3 species" is one which has less than 2% C16:3 fatty acid in the total fatty acid content of its photosynthetic tissues. As described herein, a plant can be converted from being a 16:3 plant to an 18:3 plant by suitable genetic modifications. The proportion of flux between the prokaryote and eukaryote pathways is not conserved across different plant species or tissues. In 16:3 species up to 40% of flux in leaves occurs via the prokaryotic pathway (Browse et al., 1986), while in 18:3 species, such as pea and soybean, about 90% of FAs which are synthesized in the plastid are exported out of the plastid to the ER to supply the source of FA for the eukaryotic pathway (Ohlrogge and Browse, 1995; Somerville et al., 2000).

Therefore different amounts of 18:3 and 16:3 fatty acids are found within the glycolipids of different plant species. This is used to distinguish between 18:3 plants whose fatty acids with 3 double bonds are almost entirely C18 fatty acids and the 16:3 plants that contain both $C_{16}$- and $C_{18}$-fatty acids having 3 double bonds. In chloroplasts of 18:3 plants, enzymic activities catalyzing the conversion of phosphatidate to diacylglycerol and of diacylglycerol to monogalactosyl diacylglycerol (MGD) are significantly less active than in 16:3 chloroplasts. In leaves of 18:3 plants, chloroplasts synthesize stearoyl-ACP2 in the stroma, introduce the first double bond into the saturated hydrocarbon chain, and then hydrolyze the thioester by thioesterases (FIG. 1). Released oleate is exported across chloroplast envelopes into membranes of the cell, probably the endoplasmic reticulum, where it is incorporated into PC. PC-linked oleoyl groups are desaturated in these membranes and subsequently move back into the chloroplast. The MGD-linked acyl groups are substrates for the introduction of the third double bond to yield MGD with two linolenoyl residues. This galactolipid is characteristic of 18:3 plants such as Asteraceae and Fabaceae, for example. In photosynthetically active cells of 16:3 plants which are represented, for example, by members of Apiaceae and Brassicaceae, two pathways operate in parallel to provide thylakoids with MGD.

In one embodiment, the plant or part thereof such as a vegetative plant part of the invention produces higher levels of non-polar lipids such as TAG, or total fatty acid (TFA) content, preferably both, than a corresponding plant or part thereof such as a vegetative plant part which lacks the genetic modifications or exogenous polynucleotides. In one example, plants of the invention produce seeds, leaves, or have leaf portions of at least 1 cm² in surface area, stems and/or tubers having an increased non-polar lipid content such as TAG or TFA content, preferably both, when compared to corresponding seeds, leaves, leaf portions of at least 1 cm² in surface area, stems or tubers.

In another embodiment, the plant or part thereof such as a vegetative plant part, produce TAGs that are enriched for one or more particular fatty acids. A wide spectrum of fatty acids can be incorporated into TAGs, including saturated and unsaturated fatty acids and short-chain and long-chain fatty acids. Some non-limiting examples of fatty acids that can be incorporated into TAGs and which may be increased in level include: capric (10:0), lauric (12:0), myristic (14:0), palmitic (16:0), palmitoleic (16:1), stearic (18:0), oleic (18:1), vaccenic (18:1), linoleic (18:2), eleostearic (18:3), γ-linolenic (18:3), α-linolenic (18:3ω3), stearidonic (18:4ω3), arachidic (20:0), eicosadienoic (20:2), dihomo-γ-linoleic (20:3), eicosatrienoic (20:3), arachidonic (20:4), eicosatetraenoic (20:4), eicosapentaenoic (20:5ω3), behenic (22:0), docosapentaenoic (22:5ω), docosahexaenoic (22:6ω3), lignoceric (24:0), nervonic (24:1), cerotic (26:0), and montanic (28:0) fatty acids. In one embodiment of the present invention, the plant or part thereof is enriched for TAGs comprising oleic acid, and/or is reduced in linolenic acid (ALA), preferably by at least 2% or at least 5% on an absolute basis.

Preferably, the plant or part thereof such as a vegetative plant part of the invention is transformed with one or more exogenous polynucleotides such as chimeric DNAs. In the case of multiple chimeric DNAs, these are preferably covalently linked on one DNA molecule such as, for example, a single T-DNA molecule, and preferably integrated at a single locus in the host cell genome, preferably the host nuclear genome. Alternatively, the chimeric DNAs are on two or more DNA molecules which may be unlinked in the host genome, or the DNA molecule(s) is not integrated into the host genome, such as occurs in transient expression experiments. The plant or part thereof such as a vegetative plant part is preferably homozygous for the one DNA molecule inserted into its genome.

Transcription Factors

Various transcription factors are involved in plant cells in the synthesis of fatty acids and lipids incorporating the fatty acids such as TAG, and therefore can be manipulated for the Push modification. A preferred transcription factor is WRI1. As used herein, the term "Wrinkled 1" or "WRI1" or "WRL1" refers to a transcription factor of the AP2/ER-WEBP class which regulates the expression of several enzymes involved in glycolysis and de novo fatty acid biosynthesis. WRI1 has two plant-specific (AP2/EREB) DNA-binding domains. WRI1 in at least *Arabidopsis* also regulates the breakdown of sucrose via glycolysis thereby regulating the supply of precursors for fatty acid biosynthesis. In other words, it controls the carbon flow from the photosynthate to storage lipids. wri1 mutants in at least *Arabidopsis* have a wrinkled seed phenotype, due to a defect in the incorporation of sucrose and glucose into TAGs.

Examples of genes which are transcribed by WRI1 include, but are not limited to, one or more, preferably all, of genes encoding pyruvate kinase (At5g52920, At3g22960), pyruvate dehydrogenase (PDH) E1alpha subunit (At1g01090), acetyl-CoA carboxylase (ACCase), BCCP2 subunit (At5g15530), enoyl-ACP reductase (At2g05990; EAR), phosphoglycerate mutase (At1g22170), cytosolic fructokinase, and cytosolic phosphoglycerate mutase, sucrose synthase (SuSy) (see, for example, Liu et al., 2010; Baud et al., 2007; Ruuska et al., 2002).

WRI1 contains the conserved domain AP2 (cd00018). AP2 is a DNA-binding domain found in transcription regulators in plants such as APETALA2 and EREBP (ethylene responsive element binding protein). In EREBPs the domain specifically binds to the 1 lbp GCC box of the ethylene response element (ERE), a promotor element essential for ethylene responsiveness. EREBPs and the C-repeat binding factor CBF1, which is involved in stress response, contain a single copy of the AP2 domain. APETALA2-like proteins, which play a role in plant development contain two copies.

Other sequence motifs which may be found in WRI1 and its functional homologs include:

1.
                              (SEQ ID NO: 89)
R G V T/S R H R W T G R.

2.
                              (SEQ ID NO: 90)
F/Y E A H L W D K.

3.
                              (SEQ ID NO: 91)
D L A A L K Y W G.

4.
                              (SEQ ID NO: 92)
S X G F S/A R G X.

5.
                              (SEQ ID NO: 93)
H H H/Q N G R/K W E A R I G R/K V.

6.
                              (SEQ ID NO: 94)
Q E E A A A X Y D.

As used herein, the term "Wrinkled 1" or "WRI1" also includes "Wrinkled 1-like" or "WRI1-like" proteins. Examples of WRI1 proteins include Accession Nos: Q6X5Y6, (*Arabidopsis thaliana*; SEQ ID NO:22), XP_002876251.1 (*Arabidopsis lyrata* subsp. *Lyrata*; SEQ ID NO:23), ABD16282.1 (*Brassica napus*; SEQ ID NO:24), AD016346.1 (*Brassica napus*; SEQ ID NO:25), XP_003530370.1 (*Glycine max*; SEQ ID NO:26), AE022131.1 (*Jatropha curcas*; SEQ ID NO:27), XP_002525305.1 (*Ricinus communis*; SEQ ID NO:28), XP_002316459.1 (*Populus trichocarpa*; SEQ ID NO:29), CB129147.3 (*Vitis vinifera*; SEQ ID NO:30), XP_003578997.1 (*Brachypodium distachyon*; SEQ ID NO:31), BAJ86627.1 (*Hordeum vulgare* subsp. *vulgare*; SEQ ID NO:32), EAY79792.1 (*Oryza sativa*; SEQ ID NO:33), XP_002450194.1 (*Sorghum bicolor*; SEQ ID NO:34), ACG32367.1 (*Zea mays*; SEQ ID NO:35), XP_003561189.1 (*Brachypodium distachyon*; SEQ ID NO:36), ABL85061.1 (*Brachypodium sylvaticum*; SEQ ID NO:37), BAD68417.1 (*Oryza sativa*; SEQ ID NO:38), XP_002437819.1 (*Sorghum bicolor*; SEQ ID NO:39), XP_002441444.1 (*Sorghum bicolor*; SEQ ID NO:40), XP_003530686.1 (*Glycine max*; SEQ ID NO:41), XP_003553203.1 (*Glycine max*; SEQ ID NO:42), XP_002315794.1 (*Populus trichocarpa*; SEQ ID NO:43), XP_002270149.1 (*Vitis vinifera*; SEQ ID NO:44), XP_003533548.1 (*Glycine max*; SEQ ID NO:45), XP_003551723.1 (*Glycine max*; SEQ ID NO:46), XP_003621117.1 (*Medicago truncatula*; SEQ ID NO:47), XP_002323836.1 (*Populus trichocarpa*; SEQ ID NO:48), XP_002517474.1 (*Ricinus communis*; SEQ ID NO:49), CAN79925.1 (*Vitis vinifera*; SEQ ID NO:50), XP_003572236.1 (*Brachypodium distachyon*; SEQ ID NO:51), BAD10030.1 (*Oryza sativa*; SEQ ID NO:52), XP_002444429.1 (*Sorghum bicolor*; SEQ ID NO:53), NP_001170359.1 (*Zea mays*; SEQ ID NO:54), XP_002889265.1 (*Arabidopsis lyrata* subsp. *lyrata*; SEQ ID NO:55), AAF68121.1 (*Arabidopsis thaliana*; SEQ ID NO:56), NP_178088.2 (*Arabidopsis thaliana*; SEQ ID NO:57), XP_002890145.1 (*Arabidopsis lyrata* subsp. *lyrata*; SEQ ID NO:58), BAJ33872.1 (*Thellungiella halophila*; SEQ ID NO:59), NP_563990.1 (*Arabidopsis thaliana*; SEQ ID NO:60), XP_003530350.1 (*Glycine max*; SEQ ID NO:61), XP_003578142.1 (*Brachypodium distachyon*; SEQ ID NO:62), EAZ09147.1 (*Oryza sativa*; SEQ ID NO:63), XP_002460236.1 (*Sorghum bicolor*; SEQ ID NO:64), NP_001146338.1 (*Zea mays*; SEQ ID NO:65), XP_003519167.1 (*Glycine max*; SEQ ID NO:66), XP_003550676.1 (*Glycine max*; SEQ ID NO:67), XP_003610261.1 (*Medicago truncatula*; SEQ ID NO:68), XP_003524030.1 (*Glycine max*; SEQ ID NO:69), XP_003525949.1 (*Glycine max*; SEQ ID NO:70), XP_002325111.1 (*Populus trichocarpa*; SEQ ID NO:71), CB136586.3 (*Vitis vinifera*; SEQ ID NO:72), XP_002273046.2 (*Vitis vinifera*; SEQ ID NO:73), XP_002303866.1 (*Populus trichocarpa*; SEQ ID NO:74), and CB125261.3 (*Vitis vinifera*; SEQ ID NO:75). Further examples include Sorbi-WRL1 (SEQ ID NO:76), Lupan-WRL1 (SEQ ID NO:77), Ricco-WRL1 (SEQ ID NO:78), and *Lupin angustifolius* WRI1 (SEQ ID NO:79). A preferred WRI1 is a maize WRI1 or a *sorghum* WRI1.

More recently, a subset of WRI1-like transcription factors have been re-classified as WRI2, WRI3 or WRI4 transcription factors, which are characterised by preferential expression in stems and/or roots of plants rather than in developing seeds (To et al., 2012). Despite their re-classification, these are included in the definition of "WRI1" herein. Preferred WRI1-like transcription factors are those which can complement the function of a wri1 mutation in a plant, particularly the function in developing seed of the plant such as in an *A. thaliana* wri1 mutant. The function of a WRI1-like polypeptide can also be assayed in the *N. benthamiana* transient assays as described herein.

The WRI1 transcription factor may be endogenous to the plant or cell, or exogenous to the plant or cell, for example expressed from an exogenous polynucleotide. The WRI1 transcription factor may be a naturally occurring WRI1 polypeptide or a variant thereof, provided it retains transcription factor activity. The level or activity of an endogenous WRI1 polypeptide may also be increased by increased expression of a MED15 polypeptide (Kim et al., 2016), for example polypeptides whose amino acid sequences are provided as SEQ ID NOs:293 or 295, or of a 14-3-3 polypeptide (Ma et al., 2016), for example SEQ ID NOs: 297-304 MED15 polypeptide is thought to assist in directing WRI1 to its target promoters and expression of WRI1 expression itself, while 14-3-3 polypeptides are thought to interact with WRI1 polypeptide to increase the WRI1 effect.

As used herein, a "LEAFY COTYLEDON" or "LEC" polypeptide means a transcription factor which is a LEC1, LEC1-like, LEC2, ABI3 or FUS3 transcription factor which exhibits broad control on seed maturation and fatty acid synthesis. LEC2, FUS3 and ABI3 are related polypeptides that each contain a B3 DNA-binding domain of 120 amino acids (Yamasaki et al., 2004) that is only found in plant proteins. They can be distinguished by phylogenetic analysis to determine relatedness in amino acid sequence to the members of the *A. thaliana* polypeptides having the Accession Nos as follows: LEC2, Accession No. AAL12004.1; FUS3 (also known as *FUSCA*3), Accession No. AAC35247. LEC1 belongs to a different class of polypeptides and is homologous to a HAP3 polypeptide of the CBF binding factor class (Lee et al., 2003). The LEC1, LEC2 and FUS3 genes are required in early embryogenesis to maintain embryonic cell fate and to specify cotyledon identity and in later in initiation and maintenance of embryo maturation (Santos-Mendoza et al., 2008). They also induce expression of genes encoding seed storage proteins by binding to RY motifs present in the promoters, and oleosin genes. They can also be distinguished by their expression patterns in seed development or by their ability to complement the corresponding mutation in *A. thaliana*.

As used herein, the term "Leafy Cotyledon 1" or "LEC1" refers to a NF-YB-type transcription factor which participates in zygotic development and in somatic embryogenesis. The endogenous gene is expressed specifically in seed in both the embryo and endosperm. LEC1 activates the gene encoding WRI1 as well as a large class of fatty acid synthesis genes. Ectopic expression of LEC2 also causes rapid activation of auxin-responsive genes and may cause formation of somatic embryos. Examples of LEC1 polypeptides include proteins from *Arabidopsis thaliana* (AAC39488, SEQ ID NO:149), *Medicago truncatula* (AFK49653, SEQ ID NO:154) and *Brassica napus* (ADF81045, SEQ ID NO:151), *A. lyrata* (XP_002862657, SEQ ID NO:150), *R. communis* (XP_002522740, SEQ ID NO:152), *G. max* (XP_006582823, SEQ ID NO:153), *A. hypogaea* (ADC33213, SEQ ID NO:156), *Z. mays* (AAK95562, SEQ ID NO:155).

LEC1-like (L1L) is closely related to LEC1 but has a different pattern of gene expression, being expressed earlier during embryogenesis (Kwong et al., 2003). Examples of LEC1-like polypeptides include proteins from *Arabidopsis thaliana* (AAN15924, SEQ ID NO:157), *Brassica napus* (AHI94922, SEQ ID NO:158), and *Phaseolus coccineus* LEC1-like (AAN01148, SEQ ID NO: 159).

As used herein, the term "Leafy Cotyledon 2" or "LEC2" refers to a B3 domain transcription factor which participates in zygotic development and in somatic embryogenesis and which activates expression of a gene encoding WRI1. Its ectopic expression facilitates the embryogenesis from vegetative plant tissues (Alemanno et al., 2008). Examples of LEC2 polypeptides include proteins from *Arabidopsis thaliana* (Accession No. NP_564304.1, SEQ ID NO:142), *Medicago truncatula* (Accession No. CAA42938.1, SEQ ID NO:143) and *Brassica napus* (Accession No. AD016343.1, SEQ ID NO:144).

In an embodiment, an exogenous polynucleotide of the invention which encodes a LEC2 comprises one or more of the following:

i) nucleotides encoding a polypeptide comprising amino acids whose sequence is set forth as any one of SEQ ID NOs:142 to 144, or a biologically active fragment thereof, or a polypeptide whose amino acid sequence is at least 30% identical to any one or more of SEQ ID NOs:142 to 144, ii) nucleotides whose sequence is at least 30% identical to i), and iii) a polynucleotide which hybridizes to one or both of i) or ii) under stringent conditions.

As used herein, the term "FUS3" refers to a B3 domain transcription factor which participates in zygotic development and in somatic embryogenesis and is detected mainly in the protodermal tissue of the embryo (Gazzarrini et al., 2004). Examples of FUS3 polypeptides include proteins from *Arabidopsis thaliana* (AAC35247, SEQ ID NO:160), *Brassica napus* (XP_006293066.1, SEQ ID NO:161) and *Medicago truncatula* (XP_003624470, SEQ ID NO:162). Over-expression of any of LEC1, L1L, LEC2, FUS3 and ABI3 from an exogenous polynucleotide is preferably controlled by a developmentally regulated promoter such as a senescence specific promoter, an inducible promoter, or a promoter which has been engineered for providing a reduced level of expression relative to a native promoter, particularly in plants other than *Arabidopsis thaliana* and *B. napus* cv. Westar, in order to avoid developmental abnormalities in plant development that are commonly associated with over-expression of these transcription factors (Mu et al., 2008).

As used herein, the term "BABY BOOM" or "BBM" refers an AP2/ERF transcription factor that induces regeneration under culture conditions that normally do not support regeneration in wild-type plants. Ectopic expression of *Brassica napus* BBM (BnBBM) genes in *B. napus* and *Arabidopsis* induces spontaneous somatic embryogenesis and organogenesis from seedlings grown on hormone-free basal medium (Boutilier et al., 2002). In tobacco, ectopic BBM expression is sufficient to induce adventitious shoot and root regeneration on basal medium, but exogenous cytokinin is required for somatic embryo (SE) formation (Srinivasan et al., 2007). Examples of BBM polypeptides include proteins from *Arabidopsis thaliana* (Accession No. NP_197245.2, SEQ ID NO:145), maize (U.S. Pat. No. 7,579,529), *Sorghum bicolor* (Accession No. XP_002458927) and *Medicago truncatula* (Accession No. AAW82334.1, SEQ ID NO:146).

In an embodiment, an exogenous polynucleotide of the invention which encodes BBM comprises, unless specified otherwise, one or more of the following:

i) nucleotides encoding a polypeptide comprising amino acids whose sequence is set forth as one of SEQ ID NOs:145 or 146, or a biologically active fragment thereof, or a polypeptide whose amino acid sequence is at least 30% identical to one or both of SEQ ID NOs: 145 or 146, ii) nucleotides whose sequence is at least 30% identical to i), and iii) a polynucleotide which hybridizes to one or both of i) or ii) under stringent conditions.

An ABI3 polypeptide (*A. thaliana* Accession No. NP_189108) is related to the maize VP1 protein, is expressed at low levels in vegetative tissues and affects plastid development. An ABI4 polypeptide (*A. thaliana* Accession NP_181551) belongs to a family of transcription factors that contain a plant-specific AP2 domain (Finkelstein et al., 1998) and acts downstream of ABI3. ABI5 (*A. thaliana* Accession No. NP_565840) is a transcription factor of the bZIP family which affects ABA sensitivity and controls the expression of some LEA genes in seeds. It binds to an ABA-responsive element.

Each of the following transcription factors was selected on the basis that they functioned in embryogenesis in plants. Accession numbers are provided in Table 26. Homologs of each can be readily identified in many other plant species and tested as described in Example 9.

MYB73 is a transcription factor that has been identified in soybean, involved in stress responses.

bZIP53 is a transcription factor in the bZIP protein family, identified in *Arabidopsis*.

AGL15 (Agamous-like 15) is a MADS box transcription factor which is natively expressed during embryogenesis. AGL15 is also natively expressed in leaf primordia, shoot apical meristems and young floral buds, suggesting that AGL15 may also have a function during post-germinative development. AGL15 has a role in embryogenesis and gibberellic acid catabolism. It targets B3 domain transcription factors that are key regulators of embryogenesis.

MYB115 and MYB118 are transcription factors in the MYB family from *Arabidopsis* involved in embryogenesis.

TANMEI also known as EMB2757 encodes a WD repeat protein required for embryo development in *Arabidopsis*.

WUS, also known as Wuschel, is a homeobox gene that controls the stem cell pool in embryos. It is expressed in the stem cell organizing center of meristems and is required to keep the stem cells in an undifferentiated state. The transcription factor binds to a TAAT element core motif.

GFR2a1 and GFR2a2 are transcription factors at least from soybean.

Fatty Acyl Acyltransferases

As used herein, the term "fatty acyl acyltransferase" refers to a protein which is capable of transferring an acyl group from acyl-CoA, PC or acyl-ACP, preferably acyl-CoA or PC, onto a substrate to form TAG, DAG or MAG. These acyltransferases include DGAT, PDAT, MGAT, GPAT and LPAAT.

As used herein, the term "diacylglycerol acyltransferase" (DGAT) refers to a protein which transfers a fatty acyl group from acyl-CoA to a DAG substrate to produce TAG. Thus, the term "diacylglycerol acyltransferase activity" refers to the transfer of an acyl group from acyl-CoA to DAG to produce TAG. A DGAT may also have MGAT function but predominantly functions as a DGAT, i.e., it has greater catalytic activity as a DGAT than as a MGAT when the enzyme activity is expressed in units of nmoles product/min/mg protein (see for example, Yen et al., 2005). The activity of DGAT may be rate-limiting in TAG synthesis in seeds (Ichihara et al., 1988). DGAT uses an acyl-CoA substrate as the acyl donor and transfers it to the sn-3 position of DAG to form TAG. The enzyme functions in its native state in the endoplasmic reticulum (ER) of the cell.

There are three known types of DGAT, referred to as DGAT1, DGAT2 and DGAT3, respectively. DGAT1 polypeptides are membrane proteins that typically have 10 transmembrane domains, DGAT2 polypeptides are also membrane proteins but typically have 2 transmembrane domains, whilst DGAT3 polypeptides typically have none and are thought to be soluble in the cytoplasm, not integrated into membranes. Plant DGAT1 polypeptides typically have about 510-550 amino acid residues while DGAT2 polypeptides typically have about 310-330 residues. DGAT1 is the main enzyme responsible for producing TAG from DAG in most developing plant seeds, whereas DGAT2s from plant species such as tung tree (*Vernicia fordii*) and castor bean (*Ricinus communis*) that produce high amounts of unusual fatty acids appear to have important roles in the accumulation of the unusual fatty acids in TAG. Over-expression of AtDGAT1 in tobacco leaves resulted in a 6-7 fold increased TAG content (Bouvier-Nave et al., 2000).

Examples of DGAT1 polypeptides include DGAT1 proteins from *Aspergillus fumigatus* (XP_755172.1; SEQ ID NO:80), *Arabidopsis thaliana* (CAB44774.1; SEQ ID NO:1), *Ricinus communis* (AAR11479.1; SEQ ID NO:81), *Vernicia fordii* (ABC94472.1; SEQ ID NO:82), *Vernonia galamensis* (ABV21945.1 and ABV21946.1; SEQ ID NO:83 and SEQ ID NO:84, respectively), *Euonymus alatus* (AAV31083.1; SEQ ID NO:85), *Nannochloropsis oceanica* (Zienkiewicz et al 2017), yeast (Zulu et al 2017), *Caenorhabditis elegans* (AAF82410.1; SEQ ID NO:86), *Rattus norvegicus* (NP_445889.1; SEQ ID NO:87), *Homo sapiens* (NP_036211.2; SEQ ID NO:88), as well as variants and/or mutants thereof. Examples of DGAT2 polypeptides include proteins encoded by DGAT2 genes from *Arabidopsis thaliana* (NP_566952.1; SEQ ID NO:2), *Ricinus communis* (AAY16324.1; SEQ ID NO:3), *Vernicia fordii* (ABC94474.1; SEQ ID NO:4), *Mortierella ramanniana* (AAK84179.1; SEQ ID NO:5), *Homo sapiens* (Q96PD7.2; SEQ ID NO:6) (Q58HT5.1; SEQ ID NO:7), *Bos taurus* (Q70VZ8.1; SEQ ID NO:8), *Mus musculus* (AAK84175.1; SEQ ID NO:9), as well as variants and/or mutants thereof. DGAT1 and DGAT2 amino acid sequences show little homology. Expression in leaves of an exogenous DGAT2 was twice as effective as a DGAT1 in increasing oil content (TAG). Further, *A. thaliana* DGAT2 had a greater preference for linoleoyl-CoA and linolenoyl-CoA as acyl donors relative to oleoyl-CoA, compared to DGAT1. This substrate preference can be used to distinguish the two DGAT classes in addition to their amino acid sequences.

Examples of DGAT3 polypeptides include proteins encoded by DGAT3 genes from peanut (*Arachis hypogaea*, Saha, et al., 2006), as well as variants and/or mutants thereof. A DGAT has little or no detectable MGAT activity, for example, less than 300 pmol/min/mg protein, preferably less than 200 pmol/min/mg protein, more preferably less than 100 pmol/min/mg protein.

In an embodiment, an exogenous polynucleotide of the invention which encodes a DGAT1 comprises one or more of the following:
  i) nucleotides encoding a polypeptide comprising amino acids whose sequence is set forth as any one of SEQ ID NOs:1 or 80 to 88, or a biologically active fragment thereof, or a polypeptide whose amino acid sequence is at least 30% identical to any one or more of SEQ ID NOs: 1 or 80 to 88,
  ii) nucleotides whose sequence is at least 30% identical to i), and
  iii) a polynucleotide which hybridizes to one or both of i) or ii) under stringent conditions.

In an embodiment, an exogenous polynucleotide of the invention which encodes a DGAT2 comprises one or more of the following:
  i) nucleotides encoding a polypeptide comprising amino acids whose sequence is set forth as any one of SEQ ID NOs:2 to 9, or a biologically active fragment thereof, or a polypeptide whose amino acid sequence is at least 30% identical to any one or more of SEQ ID NOs: 2 to 9,
  ii) nucleotides whose sequence is at least 30% identical to i), and
  iii) a polynucleotide which hybridizes to one or both of i) or ii) under stringent conditions.

As used herein, the term "phospholipid:diacylglycerol acyltransferase" (PDAT; EC 2.3.1.158) or its synonym "phospholipid:1,2-diacyl-sn-glycerol O-acyltransferase" means an acyltransferase that transfers an acyl group from a phospholipid, typically from the sn-2 position of PC, to the sn-3 position of DAG to form TAG and lysophosphocholine (LPC). This reaction is different to DGAT and uses phospholipids as the acyl-donors. Increased expression of PDAT such as PDAT1, which may be exogenous or endogenous to the cell or plant of the invention, increases the production of TAG from PC. The enzyme LPCAT can re-acylate the LPC to form more PC, allowing for continued production of DAG by PDAT. There are several forms of PDAT in plant cells including PDAT1, PDAT2 or PDAT3 (Ghosal et al., 2007). Sequences of exemplary PDAT coding regions and polypeptides are provided herein as SEQ ID NOs:258-261 (*Sorghum* and *Zea mays* PDAT1, Accession Nos XM_002462417.1 and NM_001147943), (Dahlqvist et al., 2000; Fan et al., 2013; Fan et al., 2014) although any PDAT encoding gene can be used. Homologs and naturally occurring variants of PDATs from these or other plant, fungal or algal species can readily be identified and used in the present invention. In an embodiment, the homolog or variant is at least 95% identical, preferably at least 99% identical, to the amino acid sequence of the listed SEQ ID NO or Accession No. The PDAT may be exogenous or endogenous to the plant or part thereof.

As used herein, the term "monoacylglycerol acyltransferase" or "MGAT" refers to a protein which transfers a fatty acyl group from acyl-CoA to a MAG substrate, for example sn-2 MAG, to produce DAG. Thus, the term "monoacylglycerol acyltransferase activity" at least refers to the transfer of an acyl group from acyl-CoA to MAG to produce DAG. The term "MGAT" as used herein includes enzymes that act on sn-1/3 MAG and/or sn-2 MAG substrates to form sn-1,3 DAG and/or sn-1,2/2,3-DAG, respectively. In a preferred embodiment, the MGAT has a preference for sn-2 MAG substrate relative to sn-1 MAG, or substantially uses only sn-2 MAG as substrate. As used herein, MGAT does not include enzymes which transfer an acyl group preferentially to LysoPA relative to MAG, such enzymes are known as LPAATs. That is, a MGAT preferentially uses non-phosphorylated monoacyl substrates, even though they may also have low catalytic activity on LysoPA. A preferred MGAT does not have detectable activity in acylating LysoPA. A MGAT may also have DGAT function but predominantly functions as a MGAT, i.e., it has greater catalytic activity as a MGAT than as a DGAT when the enzyme activity is expressed in units of nmoles product/min/mg protein (also see Yen et al., 2002). There are three known classes of MGAT, referred to as, MGAT1, MGAT2 and MGAT3, respectively. Examples of MGAT1, MGAT2 and MGAT3 polypeptides are described in WO2013/096993.

As used herein, an "MGAT pathway" refers to an anabolic pathway, different to the Kennedy pathway for the formation of TAG, in which DAG is formed by the acylation of either sn-1 MAG or preferably sn-2 MAG, catalysed by MGAT. The DAG may subsequently be used to form TAG or other lipids. WO2012/000026 demonstrated firstly that plant leaf tissue can synthesise MAG from G-3-P such that the MAG is accessible to an exogenous MGAT expressed in the leaf tissue, secondly MGAT from various sources can function in plant tissues, requiring a successful interaction with other plant factors involved in lipid synthesis and thirdly the DAG produced by the exogenous MGAT activity is accessible to a plant DGAT, or an exogenous DGAT, to produce TAG. MGAT and DGAT activity can be assayed by introducing constructs encoding the enzymes (or candidate enzymes) into *Saccharomyces cerevisiae* strain H1246 and demonstrating TAG accumulation.

Some of the motifs that have been shown to be important for catalytic activity in some DGAT2s are also conserved in MGAT acyltransferases. Of particular interest is a putative neutral lipid-binding domain with the concensus sequence FLXLXXXN (SEQ ID NO:14) where each X is independently any amino acid other than proline, and N is any nonpolar amino acid, located within the N-terminal transmembrane region followed by a putative glycerol/phospholipid acyltransferase domain. The FLXLXXXN motif (SEQ ID NO:14) is found in the mouse DGAT2 (amino acids 81-88) and MGAT1/2 but not in yeast or plant DGAT2s. It is important for activity of the mouse DGAT2. Other DGAT2 and/or MGAT1/2 sequence motifs include:
1. A highly conserved YFP tripeptide (SEQ ID NO:10) in most DGAT2 polypeptides and also in MGAT1 and MGAT2, for example, present as amino acids 139-141 in mouse DGAT2. Mutating this motif within the yeast DGAT2 with non-conservative substitutions rendered the enzyme non-functional.
2. HPHG tetrapeptide (SEQ ID NO:11), highly conserved in MGATs as well as in DGAT2 sequences from animals and fungi, for example, present as amino acids 161-164 in mouse DGAT2, and important for catalytic activity at least in yeast and mouse DGAT2. Plant DGAT2 acyltransferases have a EPHS (SEQ ID NO:12) conserved sequence instead, so conservative changes to the first and fourth amino acids can be tolerated.
3. A longer conserved motif which is part of the putative glycerol phospholipid domain. An example of this motif is RXGFX(K/R)XAXXXGXXX(L/V)VPXXXFG(E/Q) (SEQ ID NO:13), which is present as amino acids 304-327 in mouse DGAT2. This motif is less conserved in amino acid sequence than the others, as would be expected from its length, but homologs can be recognised by motif searching. The spacing may vary between the more conserved amino acids, i.e., there may be additional X amino acids within the motif, or less X amino acids compared to the sequence above.

One important component in glycerolipid synthesis from fatty acids esterified to ACP or CoA is the enzyme sn-glycerol-3-phosphate acyltransferase (GPAT), which is another of the polypeptides involved in the biosynthesis of non-polar lipids. This enzyme is involved in different metabolic pathways and physiological functions. It catalyses the following reaction: G3P+fatty acyl-ACP or -CoA→LPA+free-ACP or -CoA. The GPAT-catalyzed reaction occurs in three distinct plant subcellular compartments: plastid, endoplasmic reticulum (ER) and mitochondria. These reactions are catalyzed by three different types of GPAT enzymes, a soluble form localized in plastidial stroma which uses acyl-ACP as its natural acyl substrate (PGPAT in FIG. 1), and two membrane-bound forms localized in the ER and mitochondria which use acyl-CoA and acyl-ACP as natural acyl donors, respectively (Chen et al., 2011).

As used herein, the term "glycerol-3-phosphate acyltransferase" (GPAT; EC 2.3.1.15) and its synonym "glycerol-3-phosphate O-acyltransferase" refer to a protein which acylates glycerol-3-phosphate (G-3-P) to form LysoPA and/or MAG, the latter product forming if the GPAT also has phosphatase activity on LysoPA. The acyl group that is transferred is from acyl-CoA if the GPAT is an ER-type GPAT (an "acyl-CoA:sn-glycerol-3-phosphate 1-O-acyltransferase" also referred to as "microsomal GPAT") or from acyl-ACP if the GPAT is a plastidial-type GPAT (PGPAT).

Thus, the term "glycerol-3-phosphate acyltransferase activity" refers to the acylation of G-3-P to form LysoPA and/or MAG. The term "GPAT" encompasses enzymes that acylate G-3-P to form sn-1 LPA and/or sn-2 LPA, preferably sn-2 LPA. Preferably, the GPAT which may be over-expressed in the Pull modification is a membrane bound GPAT that functions in the ER of the cell, more preferably a GPAT9, and the plastidial GPAT that is down-regulated in the Prokaryotic Pathway modification is a soluble GPAT ("plastidial GPAT"). In a preferred embodiment, the GPAT has phosphatase activity. In a most preferred embodiment, the GPAT is a sn-2 GPAT having phosphatase activity which produces sn-2 MAG.

As used herein, the term "sn-1 glycerol-3-phosphate acyltransferase" (sn-1 GPAT) refers to a protein which acylates sn-glycerol-3-phosphate (G-3-P) to preferentially form 1-acyl-sn-glycerol-3-phosphate (sn-1 LPA). Thus, the term "sn-1 glycerol-3-phosphate acyltransferase activity" refers to the acylation of sn-glycerol-3-phosphate to form 1-acyl-sn-glycerol-3-phosphate (sn-1 LPA).

As used herein, the term "sn-2 glycerol-3-phosphate acyltransferase" (sn-2 GPAT) refers to a protein which acylates sn-glycerol-3-phosphate (G-3-P) to preferentially form 2-acyl-sn-glycerol-3-phosphate (sn-2 LPA). Thus, the term "sn-2 glycerol-3-phosphate acyltransferase activity" refers to the acylation of sn-glycerol-3-phosphate to form 2-acyl-sn-glycerol-3-phosphate (sn-2 LPA).

The GPAT family is large and all known members contain two conserved domains, a plsC acyltransferase domain (PF01553; SEQ ID NO:15) and a HAD-like hydrolase (PF12710; SEQ ID NO:16) superfamily domain and variants thereof. In addition to this, at least in *Arabidopsis thaliana*, GPATs in the subclasses GPAT4-GPAT8 all contain a N-terminal region homologous to a phosphoserine phosphatase domain (PF00702; SEQ ID NO:17), and GPATs which produce MAG as a product can be identified by the presence of such a homologous region. Some GPATs expressed endogenously in leaf tissue comprise the conserved amino acid sequence GDLVICPEGTTCREP (SEQ ID NO:18). GPAT4 and GPAT6 both contain conserved residues that are known to be critical to phosphatase activity, specifically conserved amino acids in Motif I (DXDX[T/V][L/V]; SEQ ID NO:19) and Motif III (K-[G/S][D/S]XXX[D/N]; SEQ ID NO:20) located at the N-terminus (Yang et al., 2010).

Homologues of *Arabidopsis* GPAT4 (Accession No. NP_171667.1) and GPAT6 (NP_181346.1) include AAF02784.1 (*Arabidopsis thaliana*), AAL32544.1 (*Arabidopsis thaliana*), AAP03413.1 (*Oryza sativa*), ABK25381.1 (*Picea sitchensis*), ACN34546.1 (*Zea Mays*), BAF00762.1 (*Arabidopsis thaliana*), BAH00933.1 (*Oryza sativa*), EAY84189.1 (*Oryza sativa*), EAY98245.1 (*Oryza sativa*), EAZ21484.1 (*Oryza sativa*), EEC71826.1 (*Oryza sativa*), EEC76137.1 (*Oryza sativa*), EEE59882.1 (*Oryza sativa*), EFJ08963.1 (*Selaginella moellendorffii*), EFJ11200.1 (*Selaginella moellendorffii*), NP_001044839.1 (*Oryza sativa*), NP_001045668.1 (*Oryza sativa*), NP_001147442.1 (*Zea mays*), NP_001149307.1 (*Zea mays*), NP_001168351.1 (*Zea mays*), AFH02724.1 (*Brassica napus*) NP_191950.2 (*Arabidopsis thaliana*), XP_001765001.1 (*Physcomitrella patens*), XP_001769671.1 (*Physcomitrella patens*), (*Vitis vinifera*), XP_002275348.1 (*Vitis vinifera*), XP_002276032.1 (*Vitis vinifera*), XP_002279091.1 (*Vitis vinifera*), XP_002309124.1 (*Populus trichocarpa*), XP_002309276.1 (*Populus trichocarpa*), XP_002322752.1 (*Populus trichocarpa*), XP_002323563.1 (*Populus trichocarpa*), XP_002439887.1 (*Sorghum bicolor*), XP_002458786.1 (*Sorghum bicolor*), XP_002463916.1 (*Sorghum bicolor*), XP_002464630.1 (*Sorghum bicolor*), XP_002511873.1 (*Ricinus communis*), XP_002517438.1 (*Ricinus communis*), XP_002520171.1 (*Ricinus communis*), ACT32032.1 (*Vernicia fordii*), NP_001051189.1 (*Oryza sativa*), AFH02725.1 (*Brassica napus*), XP_002320138.1 (*Populus trichocarpa*), XP_002451377.1 (*Sorghum bicolor*), XP_002531350.1 (*Ricinus communis*), and XP_002889361.1 (*Arabidopsis lyrata*).

The soluble plastidial GPATs (PGPAT, also known as ATS1 in *Arabidopsis thaliana*) have been purified and genes encoding them cloned from several plant species such as pea (*Pisum sativum*, Accession number: P30706.1), spinach (*Spinacia oleracea*, Accession number: Q43869.1), squash (*Cucurbita moschate*, Accession number: P10349.1), cucumber (*Cucumis sativus*, Accession number: Q39639.1) and *Arabidopsis thaliana* (Accession number: Q43307.2). The soluble plastidial GPAT is the first committed step for what is known as the prokaryotic pathway of glycerolipid synthesis and is operative only in the plastid (FIG. 1). The so-called prokaryotic pathway is located exclusively in plant plastids and assembles DAG for the synthesis of galactolipids (MGDG and DGMG) which contain C16:3 fatty acids esterified at the sn-2 position of the glycerol backbone.

Conserved motifs and/or residues can be used as a sequence-based diagnostic for the identification of GPAT enzymes. Alternatively, a more stringent function-based assay could be utilised. Such an assay involves, for example, feeding labelled glycerol-3-phosphate to cells or microsomes and quantifying the levels of labelled products by thin-layer chromatography or a similar technique. GPAT activity results in the production of labelled LPA whilst GPAT/phosphatase activity results in the production of labelled MAG.

As used herein, the term "lysophosphatidic acid acyltransferase" (LPAAT; EC 2.3.1.51) and its synonyms "1-acyl-glycerol-3-phosphate acyltransferase", "acyl-CoA: 1-acyl-sn-glycerol-3-phosphate 2-O-acyltransferase" and "1-acylglycerol-3-phosphate O-acyltransferase" refer to a protein which acylates lysophosphatidic acid (LPA) to form phosphatidic acid (PA). The acyl group that is transferred is from acyl-CoA if the LPAAT is an ER-type LPAAT or from acyl-ACP if the LPAAT is a plastidial-type LPAAT (PL-PAAT). Thus, the term "lysophosphatidic acid acyltransferase activity" refers to the acylation of LPA to form PA.

Oil Body Coating Polypeptides

Plant seeds and pollen accumulate TAG in subcellular structures called oil bodies which generally range from 0.5-2.5 μm in diameter. As used herein, "lipid droplets", also referred to as "oil bodies", are lipid rich cellular organelles for storage or exchange of neutral lipids including predominantly TAG. Lipid droplets can vary greatly in size from about 20 nm to 100 μm. These organelles have a TAG core surround by a phospholipid monolayer containing several embedded proteins which are involved in lipid metabolism and storage as well as lipid trafficking to other membranes, including oleosins if the oil bodies are from plant seeds or floral tissues (Jolivet et al., 2004). They generally consist of 0.5-3.5% protein while the remainder is the lipid. They are the least dense of the organelles in most cells and can therefore be isolated readily by flotation centrifugation. Oleosins represent the most abundant (at least 80%) of the protein in the membrane of oil bodies from seeds.

In an embodiment, the oil body coating polypeptide is non-allergenic, or not known to be allergenic, such as to humans. As used herein, the term "allergenic polypeptide" means a polypeptide which is characterised by the presence of two features: (i) its amino acid sequence comprises a region of at least 80 consecutive amino acids whose sequence is at least 35% identical to a sequence of at least 80 consecutive amino acids of a known allergenic protein, and (ii) its amino acid sequence comprises at least 8 consecutive amino acids which are identical in sequence to a region of at least 8 consecutive amino acids of a known allergenic protein. As used herein, a "non-allergenic polypeptide" is a polypeptide which is not an allergenic polypeptide. Preferred non-allergenic polypeptides are polypeptides which do not have each of features (i) and (ii). For clarity, non-allergenic polypeptides may have feature (i) or (ii) but not both (i) and (ii). A subset of non-allergenic polypeptides have feature (i) but not feature (ii); these are less preferred than polypeptides which have neither feature (i) nor (ii).

The features described as (i) and (ii) may be determined by carrying out a search using the AllergenOnline database and search facility, available at www.allergenonline.org. Two searches are carried out using the amino acid sequence of the polypeptide of interest, which is used as a query to search the database of known allergen sequences at AllergenOnline. The first search uses a sliding window of 80 amino acids from the polypeptide of interest (amino acids 1-80, 2-81, 3-82 etc), looking for matches of at least 35% identity by the FASTA program (Pearson and Lipman, 1988). The 35% identity for 80 amino acid segments was proposed in a scientific advisory to regulators for evaluating polypeptides in genetically modified crops, see FAO/WHO 2001 and Codex 2003. The segment matching process evaluating segments of 80 amino acids appears to be quite conservative. That is, when this first search is used on its own in classifying polypeptides as potentially allergenic, a positive match at the 35% identity level may mis-classify polypeptides as potentially allergenic when the extent of identity does not have biological significance for allergenicity. Therefore, the second search for an 8-amino acid match is also carried out, and the polypeptide of interest is classified as a potential allergen on the basis of a positive match in both searches, not just one search.

When the AllergenOnline database was searched using query sequences, polypeptides including maize WRI1, *Arabidopsis* DGAT1, palm DGAT1.1, coconut GPAT9, *Arabidopsis* FatA2, *Arabidopsis* caleosin (At2g33380), *Nannochloropsis* LDSP, pepper fibrillin, *Rhodococcus* TadA, and all caleosins tested showed zero matches in the 80 amino acid sliding window search and are therefore classified as non-allergenic. Other sequences including the vanilla U1 oleosin, Chinese tallow LDAP2, *Arabidopsis* steroleosin (At5g50600), peanut Oleosin3, sesame oleosinH, avocado oleosin, fig oleosin, cucumber oleosin, flax oleosin, soybean oleosin, *Brassica* oleosin and potato oleosin all produced one or more matches in the 80 amino acid sliding window search (i.e. at least 35% identity to a known allergenic protein in a region of at least 80 amino acids) but did not provide any matches in the 8 amino acid search. These were therefore classified as non-allergenic according to the definition above. In contrast, sesame oleosinL was identified as an allergenic polypeptide, providing matches in both searches.

As used herein, the term "Oleosin" refers to an amphipathic protein present in the membrane of oil bodies in the storage tissues of seeds (see, for example, Huang, 1996; Tai et al., 2002, Lin et al., 2005; Capuano et al., 2007; Lui et al., 2009; Shimada and Hara-Nishimura, 2010) and artificially produced variants (see for example WO2011/053169 and WO2011/127118).

Oleosins are of low $M_r$ (15-26,000), corresponding to about 140-230 amino acid residues, which allows them to become tightly packed on the surface of oil bodies. Within each seed species, there are usually two or more oleosins of different $M_r$. Each oleosin molecule contains a relatively hydrophilic, variable N-terminal domain (for example, about 48 amino acid residues), a central totally hydrophobic domain (for example, of about 70-80 amino acid residues) which is particularly rich in aliphatic amino acids such as alanine, glycine, leucine, isoleucine and valine, and an amphipathic α-helical domain of about 30-40 amino acid residues at or near the C-terminus. The central hydrophobic domain typically contains a proline knot motif of about 12 residues at its center. Generally, the central stretch of hydrophobic residues is inserted into the lipid core and the amphiphatic N-terminal and/or amphiphatic C-terminal are located at the surface of the oil bodies, with positively charged residues embedded in a phospholipid monolayer and the negatively charged ones exposed to the exterior.

As used herein, the term "Oleosin" encompasses polyoleosins which have multiple oleosin polypeptides fused together in a head-to-tail fashion as a single polypeptide (WO2007/045019), for example 2×, 4× or 6× oleosin peptides, and caleosins which bind calcium and which are a minor protein component of the proteins that coat oil bodies in seeds (Froissard et al., 2009), and steroleosins which bind sterols (WO2011/053169). However, generally a large proportion (at least 80%) of the oleosins of oil bodies will not be caleosins and/or steroleosins. The term "oleosin" also encompasses oleosin polypeptides which have been modified artificially, such oleosins which have one or more amino acid residues of the native oleosins artificially replaced with cysteine residues, as described in WO2011/053169. Typically, 4-8 residues are substituted artificially, preferably 6 residues, but as many as between 2 and 14 residues can be substituted. Preferably, both of the amphipathic N-terminal and C-terminal domains comprise cysteine substitutions. The modification increases the cross-linking ability of the oleosins and increases the thermal stability and/or the stability of the proteins against degradation by proteases.

A substantial number of oleosin protein sequences, and nucleotide sequences encoding therefor, are known from a large number of different plant species. Examples include, but are not limited to, oleosins from sesame, Arabidposis, canola, corn, rice, peanut, castor, soybean, flax, grape, cabbage, cotton, sunflower, *sorghum* and barley. Examples of oleosins (with their Accession Nos) include *Brassica napus* oleosin (CAA57545.1; SEQ ID NO:95), *Brassica napus* oleosin S1-1 (ACG69504.1; SEQ ID NO:96), *Brassica napus* oleosin S2-1 (ACG69503.1; SEQ ID NO:97), *Brassica napus* oleosin S3-1 (ACG69513.1; SEQ ID NO:98), *Brassica napus* oleosin S4-1 (ACG69507.1; SEQ ID NO:99), *Brassica napus* oleosin S5-1 (ACG69511.1; SEQ ID NO:100), *Arachis hypogaea* oleosin 1 (AAZ20276.1; SEQ ID NO:101), *Arachis hypogaea* oleosin 2 (AAU21500.1; SEQ ID NO:102), *Arachis hypogaea* oleosin 3 (AAU21501.1; SEQ ID NO:103), *Arachis hypogaea* oleosin 5 (ABC96763.1; SEQ ID NO:104), *Ricinus communis* oleosin 1 (EEF40948.1; SEQ ID NO:105), *Ricinus communis* oleosin 2 (EEF51616.1; SEQ ID NO:106), *Glycine max* oleosin isoform a (P29530.2; SEQ ID NO:107), *Glycine max* oleosin isoform b (P29531.1; SEQ ID NO:108), *Linum usitatissimum* oleosin low molecular weight isoform (ABB01622.1; SEQ ID NO:109), *Linum usitatissimum* oleosin high molecular weight isoform (ABB01624.1; SEQ ID NO:110), *Helianthus annuus* oleosin (CAA44224.1; SEQ ID NO:111), *Zea mays* oleosin (NP_001105338.1; SEQ ID NO:112), *Brassica napus* steroleosin (ABM30178.1; SEQ ID NO:113), *Brassica napus* steroleosin SLO1-1 (ACG69522.1; SEQ ID NO:114), *Brassica napus* steroleosin SL02-1 (ACG69525.1; SEQ ID NO:115), *Sesamum indicum* steroleosin (AAL13315.1; SEQ ID NO:116), *Sesame indicum* OleosinL (Tai et al., 2002; Accession number AF091840; SEQ ID NO:305), *Ficus pumila* var. *awkeotsang* oleosin L-isoform (Accession No. ABQ57397.1; SEQ ID NO: 306), *Cucumis sativus* oleosinL (Accession No. XP_004146901.1; SEQ ID NO: 307), *Linum usitatissimum* oleosinL (Accession No. ABB01618.1; SEQ ID NO: 308), *Glycine max* oleosinL (Accession No. XP_003556321.2; SEQ ID NO: 309), *Ananas comosus* oleosinL (Accession No. OAY72596.1; SEQ ID NO: 310), *Setaria italica* oleosinL (Accession No. XP_004956407.1; SEQ ID NO: 311), *Fragaria vesca* subsp. *vesca* oleosinL (Accession No. XP_004307777.1; SEQ ID NO: 312), *Brassica napus* oleosinL (Accession No. CDY03377.1; SEQ ID NO: 313), *Solanum lycopersicum* oleosinL (Accession No. XP_004240765.1; SEQ ID NO: 314), *Sesame indicum* OleosinH1 (Tai et al., 2002; Accession number AF302807), *Vanilla planifolia* leaf OleosinU1 (Huang and Huang, 2016; Accession number SRX648194), *Persea americana* mesocarp OleosinM lipid droplet associated protein (Huang and Huang, 2016; Accession number SRX627420), *Arachis hypogaea* Oleosin 3 (Parthibane et al., 2012; Accession number AY722696), *A. thaliana* Caleosin3 (Shen et al., 2014; Laibach et al., 2015; Accession number AK317039), *A. thaliana* steroleosin (Accession number AT081653), *Zea mays* steroleosin (NP_001152614.1; SEQ ID NO:117), *Brassica napus* caleosin CLO-1 (ACG69529.1; SEQ ID NO:118), *Brassica napus* caleosin CLO-3 (ACG69527.1; SEQ ID NO:119), *Sesamum indicum* caleosin (AAF13743.1; SEQ ID NO:120), *Zea mays* caleosin (NP_001151906.1; SEQ ID NO:121), *Glycine max* caleosin (AAB71227). Other lipid encapsulation polypeptides that are functionally equivalent are plastoglobulins and MLDP polypeptides (WO2011/127118).

In an embodiment, an exogenous polynucleotide of the invention which encodes an oleosin comprises, unless specified otherwise, one or more of the following:
  i) nucleotides encoding a polypeptide comprising amino acids whose sequence is set forth as any one of SEQ ID NOs:95 to 112 or 305 to 314, or a biologically active fragment thereof, or a polypeptide whose amino acid sequence is at least 30% identical to any one or more of SEQ ID NOs: 95 to 112 or 305 to 314,
  ii) nucleotides whose sequence is at least 30% identical to i), and
  iii) a polynucleotide which hybridizes to one or both of i) or ii) under stringent conditions.

In an embodiment, an exogenous polynucleotide of the invention which encodes a steroleosin comprises, unless specified otherwise, one or more of the following:
  i) nucleotides encoding a polypeptide comprising amino acids whose sequence is set forth as any one of SEQ ID NOs:113 to 117, or a biologically active fragment thereof, or a polypeptide whose amino acid sequence is at least 30% identical to any one or more of SEQ ID NOs: 113 to 117,
  ii) nucleotides whose sequence is at least 30% identical to i), and
  iii) a polynucleotide which hybridizes to one or both of i) or ii) under stringent conditions.

In an embodiment, the oleosin is oleosinL or an ortholog thereof. OleosinL lacks the about 18 amino acid H-form insertion towards the C-terminus of other oleosins (see, for example, Tai et al., 2002). Thus, OleosinL's can readily be distinguished from other oleosins based on protein alignment.

In an embodiment, an exogenous polynucleotide of the invention which encodes an oleosinL comprises, unless specified otherwise, one or more of the following:
i) nucleotides encoding a polypeptide comprising amino acids whose sequence is set forth as any one of SEQ ID NOs: 305 to 314, or a biologically active fragment thereof, or a polypeptide whose amino acid sequence is at least 30% identical to any one or more of SEQ ID NOs: 305 to 314,
ii) nucleotides whose sequence is at least 30% identical to i), and
iii) a polynucleotide which hybridizes to one or both of i) or ii) under stringent conditions.

In an alternate embodiment, an exogenous polynucleotide of the invention which encodes an oleosin comprises, unless specified otherwise, one or more of the following:
i) nucleotides encoding a polypeptide comprising amino acids whose sequence is set forth as any one of SEQ ID NOs: 306 to 314, or a biologically active fragment thereof, or a polypeptide whose amino acid sequence is at least 30% identical to any one or more of SEQ ID NOs: 306 to 314,
ii) nucleotides whose sequence is at least 30% identical to i), and
iii) a polynucleotide which hybridizes to one or both of i) or ii) under stringent conditions, wherein the oleosin is not allergenic, or not known to be allergenic, such as to humans.

As used herein, a "lipid droplet associated protein" or "LDAP" means a polypeptide which is associated with lipid droplets in plants in tissues or organs other than seeds, anthers and pollen, such as fruit tissues including pericarp and mesocarp. LDAPs may be associated with oil bodies in seeds, anthers or pollen as well as in the tissues or organs other than seeds, anthers and pollen. They are distinct from oleosins which are polypeptides associated with the surface of lipid droplets in seed tissues, anthers and pollen. LDAPs as used herein include LDAP polypeptides that are produced naturally in plant tissues as well as amino acid sequence variants that are produced artificially. The function of such variants can be tested as exemplified in Example 11.

Horn et al. (2013) identified two LDAP genes which are expressed in avocado pericarp. The encoded avocado LDAP1 and LDAP2 polypeptides were 62% identical in amino acid sequence and had homology to polypeptide encoded by *Arabidopsis* At3g05500 and a rubber tree SRPP-like protein. Gidda et al. (2013) identified three LDAP genes that were expressed in oil palm (*Elaeis guineensis*) mesocarp but not in kernels and concluded that LDAP genes were plant specific and conserved amongst all plant species. LDAP polypeptides may contain additional domains (Gidda et al., (2013). Genes encoding LDAPs are generally up-regulated in non-seed tissues with abundant lipid and can be identified thereby, but are thought to be expressed in all non-seed cells that produce oil including for transient storage. Horn et al. (2013) shows a phylogenetic tree of SRPP-like proteins in plants. Exemplary LDAP polypeptides are described in Example 11 and Example 17 herein, such as *Rhodococcus opacus* TadA lipid droplet associated protein (MacEachran et al., 2010; Accession number HM625859), *Nannochloropsis oceanica* LSDP oil body protein (Vieler et al., 2012; Accession number JQ268559) and *Trichoderma reesei* HFBI hydrophobin (Linder et al., 2005; Accession number Z68124). Homologs of LDAPs in other plant species can be readily identified by those skilled in the art.

In an embodiment, an exogenous polynucleotide of the invention which encodes a LDAP comprises, unless specified otherwise, one or more of the following:
i) nucleotides encoding a polypeptide comprising amino acids whose sequence is set forth as any one of SEQ ID NOs: 228, 230 or 232, or a biologically active fragment thereof, or a polypeptide whose amino acid sequence is at least 30% identical to any one or more of SEQ ID NOs: 228, 230 or 232,
ii) nucleotides whose sequence is at least 30% identical to i), and
iii) a polynucleotide which hybridizes to one or both of i) or ii) under stringent conditions.

As used herein, the term a "polypeptide involved in starch biosynthesis" refers to any polypeptide, the downregulation of which in a plant cell below normal (wild-type) levels results in a reduction in the level of starch synthesis and a decrease in the levels of starch. This reduces the flow of carbon from sugars into starch. An example of such a polypeptide is AGPase.

As used herein, the term "ADP-glucose phosphorylase" or "AGPase" refers to an enzyme which regulates starch biosynthesis, catalysing conversion of glucose-1-phosphate and ATP to ADP-glucose which serves as the building block for starch polymers. The active form of the AGPase enzyme consists of 2 large and 2 small subunits.

The AGPase enzyme in plants exists primarily as a tetramer which consists of 2 large and 2 small subunits. Although these subunits differ in their catalytic and regulatory roles depending on the species (Kuhn et al., 2009), in plants the small subunit generally displays catalytic activity. The molecular weight of the small subunit is approximately 50-55 kDa. Sequences of exemplary AGPase small subunit polypeptides are provided herein as SEQ ID NOs:254-257 (*Sorghum* and *Zea mays* AGPase, Accession Nos XM_002462095.1 and XM_008666513.1) (Sanjaya et al. 2011, Zale et al. 2016). The molecular weight of the large large subunit is approximately 55-60 kDa. The plant enzyme is strongly activated by 3-phosphoglycerate (PGA), a product of carbon dioxide fixation; in the absence of PGA, the enzyme exhibits only about 3% of its activity. Plant AGPase is also strongly inhibited by inorganic phosphate (Pi). In contrast, bacterial and algal AGPase exist as homotetramers of 50 kDa. The algal enzyme, like its plant counterpart, is activated by PGA and inhibited by Pi, whereas the bacterial enzyme is activated by fructose-1, 6-bisphosphate (FBP) and inhibited by AMP and Pi.

TAG Lipases and Beta-Oxidation

As used herein, the term "polypeptide involved in the degradation of lipid and/or which reduces lipid content" refers to any polypeptide which catabolises lipid, the down-regulation of which in a plant cell below normal (wild-type) levels results an increase in the level of oil, such as fatty acids and/or TAGs, in a cell of a transgenic plant or part thereof such as a vegetative part, tuber, beet or a seed. Examples of such polypeptides include, but are not limited to, lipases, or a lipase such as a CGi58 (Comparative Gene identifier-58-Like) polypeptide, a SUGAR-DEPENDENT1 (SDP1) triacylglycerol lipase (see, for example, Kelly et al., 2011) and a lipase described in WO 2009/027335.

As used herein, the term "TAG lipase" (EC.3.1.1.3) refers to a protein which hydrolyzes TAG into one or more fatty acids and any one of DAG, MAG or glycerol. Thus, the term "TAG lipase activity" refers to the hydrolysis of TAG into glycerol and fatty acids.

As used herein, the term "CGi58" refers to a soluble acyl-CoA-dependent lysophosphatidic acid acyltransferase encoded by the At4g24160 gene in *Arabidopsis thaliana* and its homologs in other plants and "Ict1p" in yeast and its homologs. The plant gene such as that from *Arabidopsis* gene locus At4g24160 is expressed as two alternative transcripts: a longer full-length isoform (At4g24160.1) and a smaller isoform (At4g24160.2) missing a portion of the 3' end (see James et al., 2010; Ghosh et al., 2009; US 201000221400). Both mRNAs code for a protein that is homologous to the human CGI-58 protein and other orthologous members of this a/13 hydrolase family (ABHD). In an embodiment, the CGI58 (At4g24160) protein contains three motifs that are conserved across plant species: a GXSXG lipase motif (SEQ ID NO:127), a HX(4)D acyltransferase motif (SEQ ID NO:128), and VX(3)HGF, a probable lipid binding motif (SEQ ID NO:129). The human CGI-58 protein has lysophosphatidic acid acyltransferase (LPAAT) activity but not lipase activity. In contrast, the plant and yeast proteins possess a canonical lipase sequence motif GXSXG (SEQ ID NO:127), that is absent from vertebrate (humans, mice, and zebrafish) proteins, and have lipase and phospholipase activity (Ghosh et al., 2009). Although the plant and yeast CGI58 proteins appear to possess detectable amounts of TAG lipase and phospholipase A activities in addition to LPAAT activity, the human protein does not.

Disruption of the homologous CGI-58 gene in *Arabidopsis thaliana* results in the accumulation of neutral lipid droplets in mature leaves. Mass spectroscopy of isolated lipid droplets from cgi-58 loss-of-function mutants showed they contain triacylglycerols with common leaf-specific fatty acids. Leaves of mature cgi-58 plants exhibit a marked increase in absolute triacylglycerol levels, more than 10-fold higher than in wild-type plants. Lipid levels in the oil-storing seeds of cgi-58 loss-of-function plants were unchanged, and unlike mutations in β-oxidation, the cgi-58 seeds germinated and grew normally, requiring no rescue with sucrose (James et al., 2010).

Examples of nucleotides encoding CGi58 polypeptides include those from *Arabidopsis thaliana* (NM_118548.1 encoding NP_194147.2; SEQ ID NO:130), *Brachypodium distachyon* (XP_003578450.1; SEQ ID NO:131), *Glycine max* (XM_003523590.1 encoding XP_003523638.1; SEQ ID NO:132), *Zea mays* (NM_001155541.1 encoding NP_001149013.1; SEQ ID NO:133), *Sorghum bicolor* (XM_002460493.1 encoding XP_002460538.1; SEQ ID NO:134), *Ricinus communis* (XM_002510439.1 encoding XP_002510485.1; SEQ ID NO:135), *Medicago truncatula* (XM_003603685.1 encoding XP_003603733.1; SEQ ID NO:136), and *Oryza sativa* (encoding EAZ09782.1).

In an embodiment, a genetic modification of the invention down-regulates endogenous production of CGi58, wherein CGi58 is encoded by one or more of the following:
  i) nucleotides comprising a sequence set forth as any one of SEQ ID NOs:130 to 136,
  ii) nucleotides comprising a sequence which is at least 30% identical to any one or more of SEQ ID NOs:130 to 136, and
  iii) a polynucleotide which hybridizes to one or both of i) or ii) under stringent conditions.

Other lipases which have lipase activity on TAG include SUGAR-DEPENDENT1 triacylglycerol lipase (SDP1, see for example Eastmond et al., 2006; Kelly et al., 2011) and SDP1-like polypeptides found in plant species as well as yeast (TGL4 polypeptide) and animal cells, which are involved in storage TAG breakdown. The SDP1 and SDP1-like polypeptides appear to be responsible for initiating TAG breakdown in seeds following germination (Eastmond et al., 2006). Plants that are mutant in SDP1, in the absence of exogenous WRI1 and DGAT1, exhibit increased levels of PUFA in their TAG. As used herein, "SDP1 polypeptides" include SDP1 polypeptides, SDP1-like polypeptides and their homologs in plant species. SDP1 and SDP1-like polypeptides in plants are 800-910 amino acid residues in length and have a patatin-like acylhydrolase domain that can associate with oil body surfaces and hydrolyse TAG in preference to DAG or MAG. SDP1 is thought to have a preference for hydrolysing the acyl group at the sn-2 position of TAG. *Arabidopsis* contains at least three genes encoding SDP1 lipases, namely SDP1 (Accession No. NP_196024, nucleotide sequence SEQ ID NO:163 and homologs in other species), SDP1L (Accession No. NM_202720 and homologs in other species, Kelly et al., 2011) and ATGLL (At1g33270) (Eastmond et al, 2006). Of particular interest for reducing gene activity are SDP1 genes which are expressed in vegetative tissues in plants, such as in leaves, stems and roots. Levels of non-polar lipids in vegetative plant parts can therefore be increased by reducing the activity of SDP1 polypeptides in the plant parts, for example by either mutation of an endogenous gene encoding a SDP1 polypeptide or introduction of an exogenous gene which encodes a silencing RNA molecule which reduces the expression of an endogenous SDP1 gene. Such a reduction is of particular benefit in tuber crops such as sugarbeet and potato, and in "high sucrose" plants such as sweet *sorghum*, sugarcane and and sugarbeet.

Genes encoding SDP1 homologues (including SDP1-like homologues) in a plant species of choice can be identified readily by homology to known SDP1 gene sequences. Known SDP1 nucleotide or amino acid sequences include Accession Nos.: in *Brassica napus*, GN078290 (SEQ ID NO:164), GN078281, GN078283; *Capsella rubella*, XP_006287072; *Theobroma cacao*, XP_007028574.1; *Populus trichocarpa*, XP_002308909 (SEQ ID NO:166); *Prunus persica*, XP_007203312; *Prunus mume*, XP_008240737; *Malus domestica*, XP_008373034; *Ricinus communis*, XP_002530081; *Medicago truncatula*, XP_003591425 (SEQ ID NO:167); *Solanum lycopersicum*, XP_004249208; *Phaseolus vulgaris*, XP_007162133; *Glycine max*, XP_003554141 (SEQ ID NO:168); *Solanum tuberosum*, XP_006351284; *Glycine max*, XP_003521151; *Cicer arietinum*, XP_004493431; *Cucumis sativus*, XP_004142709; *Cucumis melo*, XP_008457586; *Jatropha curcas*, KDP26217; *Vitis vinifera*, CBI30074; *Oryza sativa, Japonica* Group BAB61223; *Oryza sativa*, Indica Group EAY75912; *Oryza sativa, Japonica* Group NP_001044325; *Sorghum bicolor*, XP_002458531 (SEQ ID NO:169); *Brachypodium distachyon*, XP_003567139 (SEQ ID NO:165); *Zea mays*, AFW85009; *Hordeum vulgare*, BAK03290 (SEQ ID NO:172); *Aegilops tauschii*, EMT32802; *Sorghum bicolor*, XP_002463665; *Zea mays*, NP_001168677 (SEQ ID NO:170); *Hordeum vulgare*, BAK01155; *Aegilops tauschii*, EMT02623; *Triticum urartu*, EMS67257; *Physcomitrella patens*, XP_001758169 (SEQ ID NO:171). Preferred SDP1 sequences for use in genetic constructs for inhibiting expression of the endogenous genes are from cDNAs corresponding to the genes which are expressed most highly in the plant cells, vegetative plant parts or the seeds, whichever is to be modified. Nucleotide sequences which are highly conserved between cDNAs corresponding to all of the SDP1 genes in a plant species are preferred if it is desired to reduce the activity of all members of a gene family in that species.

In an embodiment, a genetic modification of the invention down-regulates endogenous production of SDP1, wherein SDP1 is encoded by one or more of the following:
i) nucleotides whose sequence is set forth as any one of SEQ ID NOs:163 to 174,
ii) nucleotides whose sequence is at least 30% identical to any one or more of the sequences set forth as SEQ ID NOs:163 to 174, and
iii) a sequence of nucleotides which hybridizes to one or both of i) or ii) under stringent conditions.

As shown in the Examples, reduction of the expression and/or activity of SDP1 TAG lipase in plant leaves greatly increased the TAG content, both in terms of the amount of TAG that accumulated and the earlier timing of accumulation during plant development, in the context of co-expression of the transcription factor WRI1 and a fatty acyl acyltransferase. In particular, the increase was observed in plants prior to flowering, and was up to about 70% on a weight basis (% dry weight) at the onset of senescence. The increase was relative to the TAG levels observed in corresponding plant leaves transformed with exogenous polynucleotides encoding the WRI1 and fatty acyl acyltransferase but lacking the modification that reduced SDP1 expression and/or activity.

Reducing the expression of other TAG catabolism genes in plant parts can also increase TAG content, such as the ACX genes encoding acyl-CoA oxidases such as the Acx1 (At4g16760 and homologs in other plant species) or Acx2 (At5g65110 and homologs in other plant species) genes. Another polypeptide involved in lipid catabolism is PXA1 which is a peroxisomal ATP-binding cassette transporter that is requires for fatty acid import for β-oxidation (Zolman et al. 2001).

Export of Fatty Acids from Plastids

As used herein, the term "polypeptide which increases the export of fatty acids out of plastids of the cell" refers to any polypeptide which aids in fatty acids being transferred from within plastids of plant cells in a plant or part thereof to outside the plastid, which may be any other part of the cell such as for example the endoplasmic reticulum (ER). Examples of such polypeptides include, but are not limited to, a C16 or C18 fatty acid thioesterase such as a FATA polypeptide or a FATB polypeptide, a C8 to C14 fatty acid thioesterase (which is also a FATB polypeptide), a fatty acid transporter such as an ABCA9 polypeptide or a long-chain acyl-CoA synthetase (LACS).

As used herein, the term "fatty acid thioesterase" or "FAT" or "acyl-ACP thioesterase" refers to an enzyme which catalyses the hydrolysis of the thioester bond between an acyl moiety and acyl carrier protein (ACP) in acyl-ACP and the release of a free fatty acid. Such enzymes typically function in the plastids of an organism which is synthesizing de novo fatty acids. As used herein, the term "C16 or C18 fatty acid thioesterase" refers to an enzyme which catalyses the hydrolysis of the thioester bond between a C16 and/or C18 acyl moiety and ACP in acyl-ACP and the release of free C16 or C18 fatty acid in the plastid. The free fatty acid is then re-esterified to CoA in the plastid envelope as it is transported out of the plastid. The substrate specificity of the fatty acid thioesterase (FAT) enzyme in the plastid is involved in determining the spectrum of chain length and degree of saturation of the fatty acids exported from the plastid. FAT enzymes can be classified into two classes based on their substrate specificity and nucleotide sequences, FATA and FATB (EC 3.1.2.14) (Jones et al., 1995). FATA polypeptides prefer oleoyl-ACP as substrate, while FATB polypeptides show higher activity towards saturated acyl-ACPs of different chain lengths such as acting on palmitoyl-ACP to produce free palmitic acid. Examples of FATA polypeptides useful for the invention include, but are not limited to, those from *Arabidopsis thaliana* (NP_189147), *Arachis hypogaea* (GU324446), *Helianthus annuus* (AAL79361), *Carthamus tinctorius* (AAA33020), *Morus notabilis* (XP_010104178.1), *Brassica napus* (CDX77369.1), *Ricinus communis* (XP_002532744.1) and *Camelina sativa* (AFQ60946.1). Examples of FATB polypeptides useful for the invention include, but are not limited to, those from *Zea mays* (AIL28766), *Brassica napus* (ABH11710), *Helianthus annuus* (AAX19387), *Arabidopsis thaliana* (AEE28300), *Umbellularia californica* (AAC49001), *Arachis hypogaea* (AFR54500), *Ricinus communis* (EEF47013) and *Brachypodium sylvaticum* (ABL85052.1).

As used herein, the term "fatty acid transporter" relates to a polypeptide present in the plastid membrane which is involved in actively transferring fatty acids from a plastid to outside the plastid. Examples of ABCA9 (ABC transporter A family member 9) polypeptides useful for the invention include, but are not limited to, those from *Arabidopsis thaliana* (Q9FLT5), *Capsella rubella* (XP_006279962.1), *Arabis alpine* (KFK27923.1), *Camelina sativa* (XP_010457652.1), *Brassica napus* (CDY23040.1) and *Brassica rapa* (XP_009136512.1).

As used herein, the term "acyl-CoA synthetase" or "ACS" (EC 6.2.1.3) means a polypeptide which is a member of a ligase family that catalyzes the formation of fatty acyl-CoA by a two-step process proceeding through an adenylated intermediate, using a non-esterified fatty acid, CoA and ATP as substrates to produce an acyl-CoA ester, AMP and pyrophosphate as products. As used herein, the term "long-chain acyl-CoA synthetase" (LACS) is an ACS that has activity on at least a C18 free fatty acid substrate although it may have broader activity on any of C14-C20 free fatty acids. The endogenous plastidial LACS enzymes are localised in the outer membrane of the plastid and function with fatty acid thioesterase for the export of fatty acids from the plastid (Schnurr et al., 2002). In *Arabidopsis*, there are at least nine identified LACS genes (Shockey et al., 2002). Preferred LACS polypeptides are of the LACS9 subclass, which in *Arabidopsis* is the major plastidial LACS. Examples of LACS polypeptides useful for the invention include, but are not limited to, those from *Arabidopsis thaliana* (Q9CAP8), *Camelina sativa* (XP_010416710.1), *Capsella rubella* (XP_006301059.1), *Brassica napus* (CDX79212.1), *Brassica rapa* (XP_009104618.1), *Gossypium raimondii* (XP_012450538.1) and *Vitis Vinifera* (XP_002285853.1). Homologs of the above mentioned polypeptides in other species can readily be identified by those skilled in the art.

Polypeptides Involved in Diacylglycerol (DAG) Production

Levels of non-polar lipids in, for example, vegetative plant parts can also be increased by reducing the activity of polypeptides involved in diacylglycerol (DAG) production in the plastid in the plant parts, for example by either mutation of an endogenous gene encoding such a polypeptide or introduction of an exogenous gene which encodes a silencing RNA molecule which reduces the expression of a target gene involved in diacylglycerol (DAG) production in the plastid.

As used herein, the term "polypeptide involved in diacylglycerol (DAG) production in the plastid" refers to any polypeptide in the plastid of plant cells in a plant or part thereof that is directly involved in the synthesis of diacylglycerol. Examples of such polypeptides include, but are not limited to, a plastidial GPAT, a plastidial LPAAT or a plastidial PAP.

GPATs are described elsewhere in the present document. Examples of plastidial GPAT polypeptides which can be targeted for down-regulation in the invention include, but are not limited to, those from *Arabidopsis thaliana* (BAA00575), *Capsella rubella* (XP_006306544.1), *Camelina sativa* (010499766.1), *Brassica napus* (CDY43010.1), *Brassica rapa* (XP_009145198.1), *Helianthus annuus* (ADV16382.1) and *Citrus unshiu* (BAB79529.1). Homologs in other species can readily be identified by those skilled in the art.

LPAATs are described elsewhere in the present document. As the skilled person would appreciate, plastidial LPAATs to be targeted for down-regulation for reducing DAG synthesis in the plastid are not endogenous LPAATs which function outside of the plastid such as those in the ER, for example being useful for producing TAG comprising medium chain length fatty acids. Examples of plastidial LPAAT polypeptides which can be targeted for down-regulation in the invention include, but are not limited to, those from *Brassica napus* (ABQ42862), *Brassica rapa* (XP_009137939.1), *Arabidopsis thaliana* (NP_194787.2), *Camelina sativa* (XP_010432969.1), *Glycine max* (XP_006592638.1) and *Solanum tuberosum* (XP_006343651.1). Homologs in other species of the above mentioned polypeptides can readily be identified by those skilled in the art.

As used herein, the term "phosphatidic acid phosphatase" (PAP) (EC 3.1.3.4) refers to a protein which hydrolyses the phosphate group on 3-sn-phosphatidate to produce 1,2-diacyl-sn-glycerol (DAG) and phosphate. Examples of plastidial PAP polypeptides which can be targeted for down-regulation in the invention include, but are not limited to, those from *Arabidopsis thaliana* (Q6NLA5), *Capsella rubella* (XP_006288605.1), *Camelina sativa* (XP_010452170.1), *Brassica napus* (CDY10405.1), *Brassica rapa* (XP_009122733.1), *Glycine max* (XP_003542504.1) and *Solanum tuberosum* (XP_006361792.1). Homologs in other species of the above mentioned polypeptides can readily be identified by those skilled in the art.

Levels of TAG in, for example, vegetative plant parts can also be increased by increasing the activity of polypeptides involved in diacylglycerol (DAG) production in the ER in the plant parts. DAG is also produced in the plants and plant parts of the invention by release of the DAG moiety from PC and can be used for synthesis of TAG. This DAG is termed herein "PC-derived DAG". The release can occur through one or more of the enzymes phosphatidylcholine:diacylglycerol cholinephosphotransferase (PDCT), the reverse reaction of choline:diacylglycerol cholinephospho-transferase (CPT), or phospholipase C (PLC) or phospholipase D (PLD). These enzymes result in DAG production in the ER rather than the plastid. As used herein, the term "phosphatidylcholine:diacylglycerol cholinephosphotransferase" or "PDCT" (EC 2.7.8.2) means an cholinephosphotransferase that transfers a phosphocholine headgroup from a phospholipid, typically PC, to produce DAG, or the reverse reaction to produce PC from DAG. PDCT can therefore interconvert PC and DAG (Lu et al., 2009; Hu et al., 2012). Thus, the two substrates of the forward reaction are cytidine monophosphate (CMP) and phosphatidylcholine and the two products are CDP-choline and DAG. PDCT belongs to the phosphatidic acid phosphatase-related protein family and typically possesses lipid phosphatase/phosphotransferase (LPT) domains. In *Arabidopsis thaliana*, PDCT is encoded by the ROD1 (At3g15820) and ROD2 (At3g15830) genes (Lu et al., 2009). Homologous genes are readily identified in other plant species (Guan et al., 2015). Sequences of exemplary PDCT coding regions and polypeptides are provided herein as SEQ ID NOs:262-265 (*Sorghum* and *Zea mays* PDCT, Accession Nos XM_002437214 and EU973573.1), although any PDCT encoding gene can be used. Exemplary PDCT polypeptides have the amino acid sequences provided by Accession Nos. NP_566527.1 (*Arabidopsis*), XP_010487422.1 (*Camelina sativa*), XP_003531718.1 (*Glycine max*), XP_013695400.1 (*Brassica napus*), XP_012073167.1 (*Jatropha curcas*), XP_002517643.1 (*Ricinus communis*) XP_013587626.1 (*Brassica oleracea*), XP_016725741.1 and XP_016725742.1 (*Gossypium hirsutum*), AQK82308.1, NP_001145186.1 (*Zea mays*), and XP_021306179.1 (*Sorghum bicolor*). Homologs and naturally occurring variants from these or other plant, fungal or algal species can readily be identified and used in the present invention. In an embodiment, the homolog or variant is at least 95% identical, preferably at least 99% identical, to the amino acid sequence of the listed Accession No. In an embodiment, the PDCT is other than *A. thaliana* PDCT (Lu et al., 2009). Increased expression of PDCT, which may be exogenous or endogenous to the cell or plant of the invention and which is preferably expressed from an exogenous polynucleotide, increases the flow of esterified acyl groups from PC to DAG and thereby increases the TTQ in the total fatty acid content and the level of TAG in vegetative plant parts or cells of the invention. Alternatively, decreasing the level of PDCT activity in the cell or plant by mutation in the gene or by a silencing RNA molecule reduces the production of PC from DAG, the reverse PDCT reaction, and allows for more of the de novo DAG to be used for TAG synthesis.

The PDCT enzyme provides for the transfer of 18:1 from DAG into PC for desaturation and also for the reverse transfer of the polyunsaturated fatty acids 18:2 and 18:3 from PC into DAG which can be used in TAG synthesis. Fatty acid labelling experiments indicate that de novo DAG and PC-derived DAG are represented by two separate pools of DAG (Bates 2016), perhaps kept spatially separated in the ER. Some reports suggest that PC-derived DAG might be the predominant form of DAG used in TAG synthesis (Bates and Browse, 2011).

As used herein, the term "CDP-choline:diacylglycerol cholinephospho-transferase" or "CPT", (EC 2.7.8.2) means an enzyme that catalyses the transfer of a choline group from CDP-choline to DAG, forming PC and CMP. This forward reaction results in the net synthesis of PC from DAG. CPT also catalyses the reverse reaction, forming DAG from PC, possibly allowing for the equilibration of DAG and PC levels in the cell. *Arabidopsis* contains two genes (AtAAPT1 and AtAAPT2, Accession Nos AAC61768.1 and AAC61769.1) that encode CPT enzymes. Mutations in either gene affect membrane homeostasis and the double mutant is lethal (Liu et al., 2015). Exemplary CPT enzymes have the amino acid sequences provided by the following Accession Nos: XP_010495346.1 and XP_019084815.1 (*Camelina sativa*); XP_013731103.1 and XP_013720632.1 (*Brassica napus*); XP_013585950.1 (*Brassica oleracea*); XP_015572083.1 (*Ricinus communis*); XP_016679754.1 (*Gossypium hirsutum*); XP_010687532.1 (*Beta vulgaris*); XP_012081980.1 (*Jatropha curcas*); XP_011070871.1 (*Sesamum indicum*); NP_001151915.1 and XP_008649199.1 (*Zea mays*); XP_002451408.1 and XP_021305900.1 (*Sorghum bicolor*). Homologs and naturally occurring variants from these or other plant, fungal or algal species can readily be identified and used in the present invention. In an embodiment, the homolog or variant is at least 95% identical, preferably at least 99% identical, to the amino acid sequence of the listed Accession No.

Phospholipases are enzymes that hydrolyze phospholipids into products such as phosphatidic acid (PA), DAG, free fatty acids (FFA) or lysophospholipids (LPL), depending on the class of phospholipase. As used herein, the term "phospholipase C" or "PLC" means an enzyme which catalyses the cleavage of a phospholipid to form DAG and a phosphorylated headgroup, where the cleavage occurs at the ester linkage between the phosphate group and the glycerol backbone of the phospholipid. The phosphorylated headgroup is phosphocholine when the phospholipid is PC. PLCs are distinct from phospholipase D enzymes which cleave the headgroup of phospholipids to form phosphatidic acid (PA) rather than DAG as product, and from phospholipase A1 and phospholipase A2 which produce FFA from the phospholipids. PLCs are membrane-associated enzymes found widely in plants, animals and prokaryoyes. PLCs can be divided into three classes, the phosphatidylinositol-specific phospholipases C (PI-PLC), the phosphatidylcholine-specific phospholipases C (PC-PLC), and the PLC which hydrolyze glycosylphosphatidylinositol (GPI)-anchored proteins (GPI-PLC), according to their substrate specificity range (Pokotylo et al., 2013, Hong et al., 2016). Multidomain animal PI-PLCs are G-protein activated enzymes regulating calcium levels and protein kinase C, and are therefore key components of the regulatory systems of cellular growth and development. The PI-PLCs are less preferred in the present invention. PC-PLCs, in plants also known as non-specific PLCs (NPC) have broader substrate ranges and are typically most active on PC, and are therefore preferred in the present invention. PC-PLCs have been identified in bacteria (Titball 1993), fungi (Morelle et al., 2005) and plants (Hong et al., 2016), the plant ones being more preferred. Six PC-PLC genes have been identified in *Arabidopsis* (Wang, 2001; Nakamura et al., 2005), nine genes in soybean (Huang et al., 2010), five genes in rice (Singh et al., 2013) and multiple copies in diverse plant species. The plant PC-PLCs are classified in several sub-groups, namely the NPC1, NPC2, NPC3-5 and NPC6 sub-groups (Pokotylo et al., 2013) based on homology to the *Arabidopsis* amino acid sequences, also having differing (but overlapping) substrate specificities and tissue distributions. For example, *Arabidopsis* NPC4 showed activity towards PC and PE, slight activity towards PS, but not PA and PIP2. NPC5 was able to cleave PC and PE, whereas NPC3 demonstrated lysophosphatidic acid (LPA) phosphatase activity resulting in MAG production as well as cleaving PC. NPC4 was expressed in mature leaves, and NPC6 was expressed in most tissues. The *Arabidopsis* PLCs have between 510 and 540 amino acid residues. In plants, PLCs are involved in lipid remodelling and the plant responses to phosphate deprivation and osmotic, salt and heat stresses, amongst other functions. Examples of PLCs include those identified, with amino acid sequences in the following Accession Nos., from *Arabidopsis*: NPC1, NP_172203.2; NPC2, NP_180255.1; NPC4, NP_566206.1; NPC5, NP_566207.1; NPC6, NP_190430.2; from *Camelina sativa*, NPC1, XP_010457889.1; NPC2, XP_010473071.1; NPC4, XP_010463802.1; NPC5, XP_010485694.1; NPC6, XP_010426358.1; from *Brassica napus* NPC1, XP_013687149.1; NPC2, XP_013744020.1; NPC4, XP_013682889.1; NPC6, XP_002511167.1; from *Ricinus communis* NPC1, XP_002525632.1; NPC4, XP_002524007.1; NPC6, XP_002511167.1; from *Gossypium hirsutum* NPC1, XP_016715492.1; NPC2, XP_016745351.1; NPC4, XP_016697678.1; NPC6, XP_016734150.1; from *Beta vulgaris* NPC1, XP_010685575.1; NPC2, XP_010673757.1; NPC4, XP_010691936.1; from *Zea mays* NPC1 homolog, NP_001170209.1; from *Oryza sativa* NPC1, XP_015631592.1; from *Glycine max* NPC1, XP_003551286.1; NPC2, XP_003556783.1; NPC4, XP_003521010.1; NPC6, XP_003523153.1; NPC6, XP_003526950.1; from *Jatropha curcas* NPC2, XP_012065897.1; NPC4, XP_012070293.1; NPC6, XP_012090681.1; from *Solanum tuberosum* NPC2, XP_006362756.1; from *Elaeis guineensis* NPC2, XP_010938556.1; NPC4, XP_010919939.1; from *Brachypodium distachyon* NPC2, XP_003565100.1; from *Trifolium subterraneum* NPC4, GAU26202.1; NPC6, GAU26767.1; from *Medicago truncatula* NPC4, XP_013444051.1; and from *Helianthus annuus* NPC6, XP_0219841571 Homologs and naturally occurring variants from these or other plant, fungal or algal species can readily be identified and used in the present invention. In an embodiment, the homolog or variant is at least 95% identical, preferably at least 99% identical, to the amino acid sequence of the listed Accession No.

As used herein, the term "phospholipase D" or "PLD" means an enzyme which catalyses the cleavage of a the phosphodiesteric linkage of a headgroup of a membrane phospholipid to form phosphatidic acid (PA) and soluble headgroup, the cleavage occurring at the phosphodiester bond distal to the glycerol backbone of the phospholipid. The soluble headgroup product is choline when the phospholipid is PC. The PA is subsequently converted to DAG by the action of PAP. Many PLDs have been identified in plants, animals, fungi and prokaryotes. All of the plant sepcies examined have a PLD family of at least 10 PLD genes (Wang, 2005), for example the *Arabidopsis* PLD family has 12 genes identified. PLDs are classified in subgroups α, β, γ, δ, ε and ζ based on sequence and enzymatic properties (Hong et al, 2016). PLDs have either a C2 domain of approximately 130 amino acids involved in calcium ion and phospholipid binding or a pleckstrin homology (PH) domain and a phox (PX) homology domain. All examined eukaryotic PLDs contain two duplicated catalytic HKD motifs, separated by more than 300 amino acids in *Arabidopsis* PLDs, but which interact with each other to form the active site (Hong et al, 2013). Exemplary PLDs include those from *Arabidopsis*: Accession Nos. AAL06337.1, CAJ58441.1; from *Camelina sativa*, XP_010465702.1, XP_010430169.1; from *Gossypium hirsutum*, XP_016724300.1; from *Ricinus communis*, XP_015573380.1; from *Solanum lycopersicum*, XP_004229274.1; from *Jatropha curcas*, XP_012083994.1; from *Glycine max*, XP_003534832.1, NP_001275522.1; from *Elaeis guineensis*, XP_010921600.1; from *Brassica rapa*, XP_009146059.1; from *Beta vulgaris*, XP_010693582.1 and XP_016713715.1; *Medicago truncatula* XP_003591178.2; and from *Brassica napus*, XP_013677646.1. Homologs and naturally occurring variants from these or other plant, fungal or algal species can readily be identified and used in the present invention. In an embodiment, the homolog or variant is at least 95% identical, preferably at least 99% identical, to the amino acid sequence of the listed Accession No.

Import of Fatty Acids into Plastids

Levels of non-polar lipids in vegetative plant parts can also be increased by reducing the activity of TGD polypeptides in the plant parts, for example by either mutation of an endogenous gene encoding a TGD polypeptide or introduction of an exogenous gene which encodes a silencing RNA molecule which reduces the expression of an endogenous TGD gene. As used herein, a "Trigalactosyldiacylglycerol (TGD) polypeptide" is one which is involved in the ER to chloroplast lipid trafficking (Xu et al., 2010; Fan et al., 2015) and involved in forming a protein complex which has permease function for lipids. Four such polypeptides are known to form or be associated with a TGD permease, namely TGD-1 (Accession No. At1g19800 and homologs in other species), TGD-2 (Accession No At2g20320 and homologs in other species), TGD-3 (Accession No. NM-105215 and homologs in other species) and TGD-4 (At3g06960 and homologs in other species) (US 20120237949). TGD5 is also involved in ER to choroplast lipid trafficking, and down-regulation of TGD5 is associated with increased oil production (US2015/337017; Fan et al., 2015). Sequences of exemplary TGD5 polypeptides are provided herein as SEQ ID NOs:250-253 (*Sorghum* and *Zea mays* TGD5, Accession Nos XM_002442154 and EU972796.1). TGD-1, -2 and -3 polypeptides are thought to be components of an ATP-Binding Cassette (ABC) transporter associated with the inner envelope membrane of the chloroplast. TGD-2 and TGD-4 polypeptides bind to phosphatidic acid whereas TGD-3 polypetide functions as an ATPase in the chloroplast stroma. As used herein, an "endogenous TGD gene" is a gene which encodes a TGD polypeptide in a plant. Mutations in TGD-1 gene in *A. thaliana* caused accumulation of triacylglycerols, oligogalactolipids and phosphatidic acid (PA) (Xu et al., 2005). Mutations in TGD genes or SDP1 genes, or indeed in any desired gene in a plant, can be introduced in a site-specific manner by artificial zinc finger nuclease (ZFN), TAL effector (TALEN) or CRISPR technologies (using a Cas9 type nuclease) as known in the art. Preferred exogenous genes encoding silencing RNAs are those encoding a double-stranded RNA molecule such as a hairpin RNA or an artificial microRNA precursor.

Sucrose Metabolism

The TAG levels and/or the TTQ of the total fatty content in the cells, plants and plant parts of the invention can also be increased by modifying sucrose metabolism, particularly in the stems of plants such as sugarcane, *Sorghum* and *Zea mays*. In an embodiment, this is achieved by increasing expression of a sucrose metabolism polypeptide such as invertase or sucrose synthase, or of a sucrose transport polypeptide such as SUS 1, SUS4, SUT2, SUT4, or SWEET. The effect of these polypeptides is to increase the supply of sucrose and its monosaccharide components in the cytosol of the cells and/or to decrease the transfer and/or storage of sucrose in the vacuoles of the cells, particularly in stem cells. Sequences of examples of these polypeptides are provided in SEQ ID NOs:274-292. Invertase such as bCIN, INV2 or INV3 acts to convert sucrose into hexoses which can be exported from the vacuoles into the cytoplasm (McKinley et al., 2016). Increased expression of SUS1 or SUS4 breaks down cytosolic sucrose into hexoses for glycolysis and de novo fatty acid synthesis rather than transfer of the sucrose into vacuoles, such as in stem parenchyma cells (McKinley et al., 2016). Increased expression of sugar transport polypeptides such as tonoplast sucrose exporter, for example SUT2 or SUT4, or SWEET polypeptide releases vacuolar sucrose for cytosolic glycolysis and increases de novo fatty acid biosynthesis (Bihmidine et al., 2016; Qazi et al., 2012; Schneider et al., 2012; Hedrich et al., 2015; Klemens et al., 2013).

The TAG levels and/or the TTQ of the total fatty content in the cells, plants and plant parts of the invention can also be increased by reducing the level of TST polypeptides such as TST1 or TST2, particularly in the stems of plants such as sugarcane, *Sorghum* and *Zea mays*. TST polypeptide can be decreased by mutation of the endogenous genes encoding the polypeptide, or by introduction of an exogenous polynucleotide that encodes a silencing RNA molecule. Sequences of exemplary TST cDNAs and polypeptides are provided as SEQ ID NOs:266-273.

Fatty Acid Modifying Enzymes

As used herein, the term "FAD2" refers to a membrane bound delta-12 fatty acid desturase that desaturates oleic acid (C18:1$^{\Delta 9}$) to produce linoleic acid (C18:2$^{\Delta 9,12}$).

As used herein, the term "epoxygenase" or "fatty acid epoxygenase" refers to an enzyme that introduces an epoxy group into a fatty acid resulting in the production of an epoxy fatty acid. In preferred embodiment, the epoxy group is introduced at the 12th carbon on a fatty acid chain, in which case the epoxygenase is a $\Delta$12-epoxygenase, especially of a C16 or C18 fatty acid chain. The epoxygenase may be a $\Delta$9-epoxygenase, a $\Delta$15 epoxygenase, or act at a different position in the acyl chain as known in the art. The epoxygenase may be of the P450 class. Preferred epoxygenases are of the mono-oxygenase class as described in WO98/46762. Numerous epoxygenases or presumed epoxygenases have been cloned and are known in the art. Further examples of expoxygenases include proteins comprising an amino acid sequence provided in SEQ ID NO:21 of WO 2009/129582, polypeptides encoded by genes from *Crepis paleastina* (CAA76156, Lee et al., 1998), *Stokesia laevis* (AAR23815) (monooxygenase type), *Euphorbia lagascae* (AAL62063) (P450 type), human CYP2J2 (arachidonic acid epoxygenase, U37143); human CYPIA1 (arachidonic acid epoxygenase, K03191), as well as variants and/or mutants thereof.

As used herein, the term, "hydroxylase" or "fatty acid hydroxylase" refers to an enzyme that introduces a hydroxyl group into a fatty acid resulting in the production of a hydroxylated fatty acid. In a preferred embodiment, the hydroxyl group is introduced at the 2nd, 12th and/or 17th carbon on a C18 fatty acid chain. Preferably, the hydroxyl group is introduced at the 12$^{th}$ carbon, in which case the hydroxylase is a $\Delta$12-hydroxylase. In another preferred embodiment, the hydroxyl group is introduced at the 15th carbon on a C16 fatty acid chain. Hydroxylases may also have enzyme activity as a fatty acid desaturase. Examples of genes encoding $\Delta$12-hydroxylases include those from *Ricinus communis* (AAC9010, van de Loo 1995); *Physaria lindheimeri*, (ABQ01458, Dauk et al., 2007); *Lesquerella fendleri*, (AAC32755, Broun et al., 1998); *Daucus carota*, (AAK30206); fatty acid hydroxylases which hydroxylate the terminus of fatty acids, for example: *A. thaliana* CYP86A1 (P48422, fatty acid ω-hydroxylase); *Vicia sativa* CYP94A1 (P98188, fatty acid ω-hydroxylase); mouse CYP2E1 (X62595, lauric acid co-1 hydroxylase); rat CYP4A1 (M57718, fatty acid ω-hydroxylase), as well as as variants and/or mutants thereof.

As used herein, the term "conjugase" or "fatty acid conjugase" refers to an enzyme capable of forming a conjugated bond in the acyl chain of a fatty acid. Examples of conjugases include those encoded by genes from *Calendula officinalis* (AF343064, Qiu et al., 2001); *Vernicia fordii* (AAN87574, Dyer et al., 2002); *Punica granatum* (AY178446, Iwabuchi et al., 2003) and *Trichosanthes kirilowii* (AY178444, Iwabuchi et al., 2003); as well as as variants and/or mutants thereof.

As used herein, the term "acetylenase" or "fatty acid acetylenase" refers to an enzyme that introduces a triple bond into a fatty acid resulting in the production of an acetylenic fatty acid. In a preferred embodiment, the triple bond is introduced at the 2nd, 6th, 12th and/or 17th carbon on a C18 fatty acid chain. Examples acetylenases include those from *Helianthus annuus* (AA038032, ABC59684), as well as as variants and/or mutants thereof.

Examples of such fatty acid modifying genes include proteins according to the following Accession Numbers which are grouped by putative function, and homologues from other species: Δ12-acetylenases ABC00769, CAA76158, AAO38036, AAO38032; Δ12 conjugases AAG42259, AAG42260, AAN87574; Δ12-desaturases P46313, ABS18716, AAS57577, AAL61825, AAF04093, AAF04094; Δ12 epoxygenases XP_001840127, CAA76156, AAR23815; Δ12-hydroxylases ACF37070, AAC32755, ABQ01458, AAC49010; and Δ12 P450 enzymes such as AF406732.

Silencing Suppressors

In an embodiment, a transgenic plant or part thereof of the invention may comprise a silencing suppressor.

As used herein, a "silencing suppressor" enhances transgene expression in a plant or part thereof of the invention. For example, the presence of the silencing suppressor results in higher levels of a polypeptide(s) produced an exogenous polynucleotide(s) in a plant or part thereof of the invention when compared to a corresponding plant or part thereof lacking the silencing suppressor. In an embodiment, the silencing suppressor preferentially binds a dsRNA molecule which is 21 base pairs in length relative to a dsRNA molecule of a different length. This is a feature of at least the p19 type of silencing suppressor, namely for p19 and its functional orthologs. In another embodiment, the silencing suppressor preferentially binds to a double-stranded RNA molecule which has overhanging 5' ends relative to a corresponding double-stranded RNA molecule having blunt ends. This is a feature of the V2 type of silencing suppressor, namely for V2 and its functional orthologs. In an embodiment, the dsRNA molecule, or a processed RNA product thereof, comprises at least 19 consecutive nucleotides, preferably whose length is 19-24 nucleotides with 19-24 consecutive basepairs in the case of a double-stranded hairpin RNA molecule or processed RNA product, more preferably consisting of 20, 21, 22, 23 or 24 nucleotides in length, and preferably comprising a methylated nucleotide, which is at least 95% identical to the complement of the region of the target RNA, and wherein the region of the target RNA is i) within a 5' untranslated region of the target RNA, ii) within a 5' half of the target RNA, iii) within a protein-encoding open-reading frame of the target RNA, iv) within a 3' half of the target RNA, or v) within a 3' untranslated region of the target RNA.

Further details regarding silencing suppressors are well known in the art and described in WO 2013/096992 and WO 2013/096993.

Polynucleotides

The terms "polynucleotide", and "nucleic acid" are used interchangeably. They refer to a polymeric form of nucleotides of any length, either deoxyribonucleotides or ribonucleotides, or analogs thereof. A polynucleotide of the invention may be of genomic, cDNA, semisynthetic, or synthetic origin, double-stranded or single-stranded and by virtue of its origin or manipulation: (1) is not associated with all or a portion of a polynucleotide with which it is associated in nature, (2) is linked to a polynucleotide other than that to which it is linked in nature, or (3) does not occur in nature. The following are non-limiting examples of polynucleotides: coding or non-coding regions of a gene or gene fragment, exons, introns, messenger RNA (mRNA), transfer RNA (tRNA), ribosomal RNA (rRNA), ribozymes, cDNA, recombinant polynucleotides, plasmids, vectors, isolated DNA of any sequence, isolated RNA of any sequence, chimeric DNA of any sequence, nucleic acid probes, and primers. For in vitro use, a polynucleotide may comprise modified nucleotides such as by conjugation with a labeling component.

As used herein, an "isolated polynucleotide" refers to a polynucleotide which has been separated from the polynucleotide sequences with which it is associated or linked in its native state, or a non-naturally occurring polynucleotide.

As used herein, the term "gene" is to be taken in its broadest context and includes the deoxyribonucleotide sequences comprising the transcribed region and, if translated, the protein coding region, of a structural gene and including sequences located adjacent to the coding region on both the 5' and 3' ends for a distance of at least about 2 kb on either end and which are involved in expression of the gene. In this regard, the gene includes control signals such as promoters, enhancers, termination and/or polyadenylation signals that are naturally associated with a given gene, or heterologous control signals, in which case, the gene is referred to as a "chimeric gene". The sequences which are located 5' of the protein coding region and which are present on the mRNA are referred to as 5' non-translated sequences. The sequences which are located 3' or downstream of the protein coding region and which are present on the mRNA are referred to as 3' non-translated sequences. The term "gene" encompasses both cDNA and genomic forms of a gene. A genomic form or clone of a gene contains the coding region which may be interrupted with non-coding sequences termed "introns", "intervening regions", or "intervening sequences." Introns are segments of a gene which are transcribed into nuclear RNA (nRNA). Introns may contain regulatory elements such as enhancers. Introns are removed or "spliced out" from the nuclear or primary transcript; introns are therefore absent in the mRNA transcript. A gene which contains at least one intron may be subject to variable splicing, resulting in alternative mRNAs from a single transcribed gene and therefore polypeptide variants. A gene in its native state, or a chimeric gene may lack introns. The mRNA functions during translation to specify the sequence or order of amino acids in a nascent polypeptide. The term "gene" includes a synthetic or fusion molecule encoding all or part of the proteins of the invention described herein and a complementary nucleotide sequence to any one of the above.

As used herein, "chimeric DNA" refers to any DNA molecule that is not naturally found in nature; also referred to herein as a "DNA construct" or "genetic construct". Typically, a chimeric DNA comprises regulatory and transcribed or protein coding sequences that are not naturally found together in nature. Accordingly, chimeric DNA may comprise regulatory sequences and coding sequences that are derived from different sources, or regulatory sequences and coding sequences derived from the same source, but arranged in a manner different than that found in nature. The open reading frame may or may not be linked to its natural upstream and downstream regulatory elements. The open reading frame may be incorporated into, for example, the plant genome, in a non-natural location, or in a replicon or vector where it is not naturally found such as a bacterial plasmid or a viral vector. The term "chimeric DNA" is not limited to DNA molecules which are replicable in a host, but includes DNA capable of being ligated into a replicon by, for example, specific adaptor sequences.

A "transgene" is a gene that has been introduced into the genome by a transformation procedure. The term includes a gene in a progeny plant or part thereof such as a vegetative plant part which was introducing into the genome of a progenitor cell thereof. Such progeny cells etc may be at least a 3$^{rd}$ or 4$^{th}$ generation progeny from the progenitor cell which was the primary transformed cell, or of the progenitor transgenic plant (referred to herein as a TO plant). Progeny may be produced by sexual reproduction or vegetatively such as, for example, from tubers in potatoes or ratoons in sugarcane. The term "genetically modified", "genetic modification" and variations thereof, is a broader term that includes introducing a gene into a cell by transformation or transduction, mutating a gene in a cell and genetically altering or modulating the regulation of a gene in a cell, or the progeny of any cell modified as described above.

A "genomic region" as used herein refers to a position within the genome where a transgene, or group of transgenes (also referred to herein as a cluster), have been inserted into a cell, or predecessor thereof. Such regions only comprise nucleotides that have been incorporated by the intervention of man such as by methods described herein.

A "recombinant polynucleotide" of the invention refers to a nucleic acid molecule which has been constructed or modified by artificial recombinant methods. The recombinant polynucleotide may be present in a cell of a plant or part thereof in an altered amount or expressed at an altered rate (e.g., in the case of mRNA) compared to its native state. In one embodiment, the polynucleotide is introduced into a cell that does not naturally comprise the polynucleotide. Typically an exogenous DNA is used as a template for transcription of mRNA which is then translated into a continuous sequence of amino acid residues coding for a polypeptide of the invention within the transformed cell. In another embodiment, the polynucleotide is endogenous to the plant or part thereof and its expression is altered by recombinant means, for example, an exogenous control sequence is introduced upstream of an endogenous gene of interest to enable the transformed plant or part thereof to express the polypeptide encoded by the gene, or a deletion is created in a gene of interest by ZFN, Talen or CRISPR methods.

A recombinant polynucleotide of the invention includes polynucleotides which have not been separated from other components of the cell-based or cell-free expression system, in which it is present, and polynucleotides produced in said cell-based or cell-free systems which are subsequently purified away from at least some other components. The polynucleotide can be a contiguous stretch of nucleotides or comprise two or more contiguous stretches of nucleotides from different sources (naturally occurring and/or synthetic) joined to form a single polynucleotide. Typically, such chimeric polynucleotides comprise at least an open reading frame encoding a polypeptide of the invention operably linked to a promoter suitable of driving transcription of the open reading frame in a cell of interest.

With regard to the defined polynucleotides, it will be appreciated that % identity figures higher than those provided above will encompass preferred embodiments. Thus, where applicable, in light of the minimum % identity figures, it is preferred that the polynucleotide comprises a polynucleotide sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

A polynucleotide of, or useful for, the present invention may selectively hybridise, under stringent conditions, to a polynucleotide defined herein. As used herein, stringent conditions are those that: (1) employ during hybridisation a denaturing agent such as formamide, for example, 50% (v/v) formamide with 0.1% (w/v) bovine serum albumin, 0.1% Ficoll, 0.1% polyvinylpyrrolidone, 50 mM sodium phosphate buffer at pH 6.5 with 750 mM NaCl, 75 mM sodium citrate at 42° C.; or (2) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 g/ml), 0.1% SDS and 10% dextran sulfate at 42° C. in 0.2×SSC and 0.1% SDS, and/or (3) employ low ionic strength and high temperature for washing, for example, 0.015 M NaCl/0.0015 M sodium citrate/0.1% SDS at 50° C.

Polynucleotides of the invention may possess, when compared to naturally occurring molecules, one or more mutations which are deletions, insertions, or substitutions of nucleotide residues. Polynucleotides which have mutations relative to a reference sequence can be either naturally occurring (that is to say, isolated from a natural source) or synthetic (for example, by performing site-directed mutagenesis or DNA shuffling on the nucleic acid as described above).

Polynucleotides for Reducing Expression of Genes

RNA Interference

RNA interference (RNAi) is particularly useful for specifically reducing the expression of a gene, which results in reduced production of a particular protein if the gene encodes a protein. Although not wishing to be limited by theory, Waterhouse et al. (1998) have provided a model for the mechanism by which dsRNA (duplex RNA) can be used to reduce protein production. This technology relies on the presence of dsRNA molecules that contain a sequence that is essentially identical to the mRNA of the gene of interest or part thereof. Conveniently, the dsRNA can be produced from a single promoter in a recombinant vector or host cell, where the sense and anti-sense sequences are flanked by an unrelated sequence which enables the sense and anti-sense sequences to hybridize to form the dsRNA molecule with the unrelated sequence forming a loop structure. The design and production of suitable dsRNA molecules is well within the capacity of a person skilled in the art, particularly considering Waterhouse et al. (1998), Smith et al. (2000), WO 99/32619, WO 99/53050, WO 99/49029, and WO 01/34815.

In one example, a DNA is introduced that directs the synthesis of an at least partly double stranded RNA product (s) with homology to the target gene to be inactivated such as, for example, a SDPJ, TGD, plastidial GPAT, plastidial LPAAT, plastidial PAP, AGPase gene. The DNA therefore comprises both sense and antisense sequences that, when transcribed into RNA, can hybridize to form the double stranded RNA region. In one embodiment of the invention, the sense and antisense sequences are separated by a spacer region that comprises an intron which, when transcribed into RNA, is spliced out. This arrangement has been shown to result in a higher efficiency of gene silencing (Smith et al., 2000). The double stranded region may comprise one or two RNA molecules, transcribed from either one DNA region or two. The presence of the double stranded molecule is thought to trigger a response from an endogenous system that destroys both the double stranded RNA and also the homologous RNA transcript from the target gene, efficiently reducing or eliminating the activity of the target gene.

The length of the sense and antisense sequences that hybridize should each be at least 19 contiguous nucleotides, preferably at least 50 contiguous nucleotides, more preferably at least 100 or at least 200 contiguous nucleotides. Generally, a sequence of 100-1000 nucleotides corresponding to a region of the target gene mRNA is used. The full-length sequence corresponding to the entire gene transcript may be used. The degree of identity of the sense sequence to the targeted transcript (and therefore also the identity of the antisense sequence to the complement of the target transcript) should be at least 85%, at least 90%, or 95-100%. The RNA molecule may of course comprise unrelated sequences which may function to stabilize the molecule. The RNA molecule may be expressed under the control of a RNA polymerase II or RNA polymerase III promoter. Examples of the latter include tRNA or snRNA promoters.

Preferred small interfering RNA ("siRNA") molecules comprise a nucleotide sequence that is identical to about 19-25 contiguous nucleotides of the target mRNA. Preferably, the siRNA sequence commences with the dinucleotide AA, comprises a GC-content of about 30-70% (preferably, 30-60%, more preferably 40-60% and more preferably about 45%-55%), and does not have a high percentage identity to any nucleotide sequence other than the target in the genome of the organism in which it is to be introduced, for example, as determined by standard BLAST search.

microRNA

MicroRNAs (abbreviated miRNAs) are generally 19-25 nucleotides (commonly about 20-24 nucleotides in plants) non-coding RNA molecules that are derived from larger precursors that form imperfect stem-loop structures. miRNAs bind to complementary sequences on target messenger RNA transcripts (mRNAs), usually resulting in translational repression or target degradation and gene silencing. Artificial miRNAs (amiRNAs) can be designed based on natural miRNAs for reducing the expression of any gene of interest, as well known in the art.

In plant cells, miRNA precursor molecules are believed to be largely processed in the nucleus. The pri-miRNA (containing one or more local double-stranded or "hairpin" regions as well as the usual 5' "cap" and polyadenylated tail of an mRNA) is processed to a shorter miRNA precursor molecule that also includes a stem-loop or fold-back structure and is termed the "pre-miRNA". In plants, the pre-miRNAs are cleaved by distinct DICER-like (DCL) enzymes, yielding miRNA:miRNA* duplexes. Prior to transport out of the nucleus, these duplexes are methylated.

In the cytoplasm, the miRNA strand from the miRNA:miRNA duplex is selectively incorporated into an active RNA-induced silencing complex (RISC) for target recognition. The RISC-complexes contain a particular subset of Argonaute proteins that exert sequence-specific gene repression (see, for example, Millar and Waterhouse, 2005; Pasquinelli et al., 2005; Almeida and Allshire, 2005).

Cosuppression

Genes can suppress the expression of related endogenous genes and/or transgenes already present in the genome, a phenomenon termed homology-dependent gene silencing. Most of the instances of homologydependent gene silencing fall into two classes—those that function at the level of transcription of the transgene, and those that operate post-transcriptionally.

Post-transcriptional homology-dependent gene silencing (i.e., cosuppression) describes the loss of expression of a transgene and related endogenous or viral genes in transgenic plants. Cosuppression often, but not always, occurs when transgene transcripts are abundant, and it is generally thought to be triggered at the level of mRNA processing, localization, and/or degradation. Several models exist to explain how cosuppression works (see in Taylor, 1997).

Cosuppression involves introducing an extra copy of a gene or a fragment thereof into a plant in the sense orientation with respect to a promoter for its expression. The size of the sense fragment, its correspondence to target gene regions, and its degree of sequence identity to the target gene can be determined by those skilled in the art. In some instances, the additional copy of the gene sequence interferes with the expression of the target plant gene. Reference is made to WO 97/20936 and EP 0465572 for methods of implementing co-suppression approaches.

Antisense Polynucleotides

The term "antisense polynucletoide" shall be taken to mean a DNA or RNA molecule that is complementary to at least a portion of a specific mRNA molecule encoding an endogenous polypeptide and capable of interfering with a post-transcriptional event such as mRNA translation. The use of antisense methods is well known in the art (see for example, G. Hartmann and S. Endres, Manual of Antisense Methodology, Kluwer (1999)). The use of antisense techniques in plants has been reviewed by Bourque (1995) and Senior (1998). Bourque (1995) lists a large number of examples of how antisense sequences have been utilized in plant systems as a method of gene inactivation. Bourque also states that attaining 100% inhibition of any enzyme activity may not be necessary as partial inhibition will more than likely result in measurable change in the system. Senior (1998) states that antisense methods are now a very well established technique for manipulating gene expression.

In one embodiment, the antisense polynucleotide hybridises under physiological conditions, that is, the antisense polynucleotide (which is fully or partially single stranded) is at least capable of forming a double stranded polynucleotide with mRNA encoding an endogenous polypeptide, for example, a SDP1, TGD, plastidial GPAT, plastidial LPAAT, plastidial PAP or AGPase mRNA under normal conditions in a cell.

Antisense molecules may include sequences that correspond to the structural genes or for sequences that effect control over the gene expression or splicing event. For example, the antisense sequence may correspond to the targeted coding region of endogenous gene, or the 5'-untranslated region (UTR) or the 3'-UTR or combination of these. It may be complementary in part to intron sequences, which may be spliced out during or after transcription, preferably only to exon sequences of the target gene. In view of the generally greater divergence of the UTRs, targeting these regions provides greater specificity of gene inhibition.

The length of the antisense sequence should be at least 19 contiguous nucleotides, preferably at least 50 nucleotides, and more preferably at least 100, 200, 500 or 1000 nucleotides. The full-length sequence complementary to the entire gene transcript may be used. The length is most preferably 100-2000 nucleotides. The degree of identity of the antisense sequence to the targeted transcript should be at least 90% and more preferably 95-100%. The antisense RNA molecule may of course comprise unrelated sequences which may function to stabilize the molecule.

Recombinant Vectors

One embodiment of the present invention includes a recombinant vector, which comprises at least one polynucleotide defined herein and is capable of delivering the polynucleotide into a host cell. Recombinant vectors include expression vectors. Recombinant vectors contain heterologous polynucleotide sequences, that is, polynucleotide sequences that are not naturally found adjacent to a polynucleotide defined herein, that preferably, are derived from a different species. The vector can be either RNA or DNA, and typically is a viral vector, derived from a virus, or a plasmid. Plasmid vectors typically include additional nucleic acid sequences that provide for easy selection, amplification, and transformation of the expression cassette in prokaryotic cells, e.g., pUC-derived vectors, pGEM-derived vectors or binary vectors containing one or more T-DNA regions. Additional nucleic acid sequences include origins of replication to provide for autonomous replication of the vector, selectable marker genes, preferably encoding antibiotic or herbicide resistance, unique multiple cloning sites providing for multiple sites to insert nucleic acid sequences or genes encoded in the nucleic acid construct, and sequences that enhance transformation of prokaryotic and eukaryotic (especially plant) cells.

"Operably linked" as used herein, refers to a functional relationship between two or more nucleic acid (e.g., DNA) segments. Typically, it refers to the functional relationship of a transcriptional regulatory element (promoter) to a transcribed sequence. For example, a promoter is operably linked to a coding sequence of a polynucleotide defined herein, if it stimulates or modulates the transcription of the coding sequence in an appropriate cell. Generally, promoter transcriptional regulatory elements that are operably linked to a transcribed sequence are physically contiguous to the transcribed sequence, i.e., they are cis-acting. However, some transcriptional regulatory elements such as enhancers need not be physically contiguous or located in close proximity to the coding sequences whose transcription they enhance.

When there are multiple promoters present, each promoter may independently be the same or different.

Recombinant vectors may also contain one or more signal peptide sequences to enable an expressed polypeptide defined herein to be retained in the endoplasmic reticulum (ER) in the cell, or transfer into a plastid, and/or contain fusion sequences which lead to the expression of nucleic acid molecules as fusion proteins. Examples of suitable signal segments include any signal segment capable of directing the secretion or localisation of a polypeptide defined herein.

To facilitate identification of transformants, the recombinant vector desirably comprises a selectable or screenable marker gene. By "marker gene" is meant a gene that imparts a distinct phenotype to cells expressing the marker gene and thus, allows such transformed cells to be distinguished from cells that do not have the marker. A selectable marker gene confers a trait for which one can "select" based on resistance to a selective agent (e.g., a herbicide, antibiotic). A screenable marker gene (or reporter gene) confers a trait that one can identify through observation or testing, that is, by "screening" (e.g., β-glucuronidase, luciferase, GFP or other enzyme activity not present in untransformed cells). Exemplary selectable markers for selection of plant transformants include, but are not limited to, a hyg gene which encodes hygromycin B resistance; a neomycin phosphotransferase (nptII) gene conferring resistance to kanamycin, paromomycin; a glutathione-S-transferase gene from rat liver conferring resistance to glutathione derived herbicides as for example, described in EP 256223; a glutamine synthetase gene conferring, upon overexpression, resistance to glutamine synthetase inhibitors such as phosphinothricin as for example, described in WO 87/05327; an acetyltransferase gene from Streptomyces viridochromogenes conferring resistance to the selective agent phosphinothricin as for example, described in EP 275957; a gene encoding a 5-enol-shikimate-3-phosphate synthase (EPSPS) conferring tolerance to N-phosphonomethylglycine as for example, described by Hinchee et al. (1988); a bar gene conferring resistance against bialaphos as for example, described in WO91/02071; a nitrilase gene such as bxn from Klebsiella ozaenae which confers resistance to bromoxynil (Stalker et al., 1988); a dihydrofolate reductase (DHFR) gene conferring resistance to methotrexate (Thillet et al., 1988); a mutant acetolactate synthase gene (ALS) which confers resistance to imidazolinone, sulfonylurea, or other ALS-inhibiting chemicals (EP 154,204); a mutated anthranilate synthase gene that confers resistance to 5-methyl tryptophan; or a dalapon dehalogenase gene that confers resistance to the herbicide.

Preferably, the recombinant vector is stably incorporated into the genome of the cell such as the plant cell. Accordingly, the recombinant vector may comprise appropriate elements which allow the vector to be incorporated into the genome, or into a chromosome of the cell.

Expression Vector

As used herein, an "expression vector" is a DNA vector that is capable of transforming a host cell and of effecting expression of one or more specified polynucleotides. Expression vectors of the present invention contain regulatory sequences such as transcription control sequences, translation control sequences, origins of replication, and other regulatory sequences that are compatible with the host cell and that control the expression of polynucleotides of the present invention. In particular, expression vectors of the present invention include transcription control sequences. Transcription control sequences are sequences which control the initiation, elongation, and termination of transcription. Particularly important transcription control sequences are those which control transcription initiation such as promoter, enhancer, operator and repressor sequences. The choice of the regulatory sequences used depends on the target organism such as a plant and/or target organ or tissue of interest. Such regulatory sequences may be obtained from any eukaryotic organism such as plants or plant viruses, or may be chemically synthesized. A number of vectors suitable for stable transfection of plant cells or for the establishment of transgenic plants have been described in for example, Pouwels et al., Cloning Vectors: A Laboratory Manual, 1985, supp. 1987, Weissbach and Weissbach, Methods for Plant Molecular Biology, Academic Press, 1989, and Gelvin et al., Plant Molecular Biology Manual, Kluwer Academic Publishers, 1990. Typically, plant expression vectors include for example, one or more cloned plant genes under the transcriptional control of 5' and 3' regulatory sequences and a dominant selectable marker. Such plant expression vectors also can contain a promoter regulatory region (e.g., a regulatory region controlling inducible or constitutive, environmentally- or developmentally-regulated, or cell- or tissue-specific expression), a transcription initiation start site, a ribosome binding site, a transcription termination site, and/or a polyadenylation signal.

A number of constitutive promoters that are active in plant cells have been described. Suitable promoters for constitutive expression in plants include, but are not limited to, the cauliflower mosaic virus (CaMV) 35S promoter, the Figwort mosaic virus (FMV) 35S, the light-inducible promoter from the small subunit (SSU) of the ribulose-1,5-bis-phosphate carboxylase, the rice cytosolic triosephosphate isomerase promoter, the adenine phosphoribosyltransferase promoter of *Arabidopsis*, the rice actin 1 gene promoter, the mannopine synthase and octopine synthase promoters, the Adh promoter, the sucrose synthase promoter, the R gene complex promoter, and the chlorophyll α/β binding protein gene promoter. These promoters have been used to create DNA vectors that have been expressed in plants, see for example, WO 84/02913. All of these promoters have been used to create various types of plant-expressible recombinant DNA vectors.

For the purpose of expression in source tissues of the plant such as the leaf, seed, root or stem, it is preferred that the promoters utilized in the present invention have relatively high expression in these specific tissues. For this purpose, one may choose from a number of promoters for genes with tissue- or cell-specific, or -enhanced expression. Examples of such promoters reported in the literature include, the chloroplast glutamine synthetase GS2 promoter from pea, the chloroplast fructose-1,6-biphosphatase promoter from wheat, the nuclear photosynthetic ST-LS1 promoter from potato, the serine/threonine kinase promoter and the glucoamylase (CHS) promoter from *Arabidopsis thaliana*. Also reported to be active in photosynthetically active tissues are the ribulose-1,5-bisphosphate carboxylase promoter from eastern larch (*Larix laricina*), the promoter for the Cab gene, Cab6, from pine, the promoter for the Cab-1 gene from wheat, the promoter for the Cab-1 gene from spinach, the promoter for the Cab 1R gene from rice, the pyruvate, orthophosphate dikinase (PPDK) promoter from *Zea mays*, the promoter for the tobacco Lhcb1*2 gene, the *Arabidopsis thaliana* Suc2 sucrose-$H^{30}$ symporter promoter, and the promoter for the thylakoid membrane protein genes from spinach (PsaD, PsaF, PsaE, PC, FNR, AtpC, AtpD, Cab, RbcS). Other promoters for the chlorophyll α/β-binding proteins may also be utilized in the present invention such as the promoters for LhcB gene and PsbP gene from white mustard (*Sinapis alba*).

A variety of plant gene promoters that are regulated in response to environmental, hormonal, chemical, and/or developmental signals, also can be used for expression of RNA-binding protein genes in plant cells, including promoters regulated by (1) heat, (2) light (e.g., pea RbcS-3A promoter, maize RbcS promoter), (3) hormones such as abscisic acid, (4) wounding (e.g., Wun1), or (5) chemicals such as methyl jasmonate, salicylic acid, steroid hormones, alcohol, Safeners (WO 97/06269), or it may also be advantageous to employ (6) organ-specific promoters.

As used herein, the term "plant storage organ specific promoter" refers to a promoter that preferentially, when compared to other plant tissues, directs gene transcription in a storage organ of a plant. For the purpose of expression in sink tissues of the plant such as the tuber of the potato plant, the fruit of tomato, or the seed of soybean, canola, cotton, *Zea mays*, wheat, rice, and barley, it is preferred that the promoters utilized in the present invention have relatively high expression in these specific tissues. The promoter for β-conglycinin or other seed-specific promoters such as the napin, zein, linin and phaseolin promoters, can be used. Root specific promoters may also be used. An example of such a promoter is the promoter for the acid chitinase gene. Expression in root tissue could also be accomplished by utilizing the root specific subdomains of the CaMV 35S promoter that have been identified.

In a particularly preferred embodiment, the promoter directs expression in tissues and organs in which lipid biosynthesis takes place. Such promoters may act in seed development at a suitable time for modifying lipid composition in seeds. Preferred promoters for seed-specific expression include: 1) promoters from genes encoding enzymes involved in lipid biosynthesis and accumulation in seeds such as desaturases and elongases, 2) promoters from genes encoding seed storage proteins, and 3) promoters from genes encoding enzymes involved in carbohydrate biosynthesis and accumulation in seeds. Seed specific promoters which are suitable are, the oilseed rape napin gene promoter (U.S. Pat. No. 5,608,152), the *Vicia faba* USP promoter (Baumlein et al., 1991), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), or the legumin B4 promoter (Baumlein et al., 1992), and promoters which lead to the seed-specific expression in monocots such as maize, barley, wheat, rye, rice and the like. Notable promoters which are suitable are the barley 1pt2 or 1pt1 gene promoter (WO 95/15389 and WO 95/23230), or the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the *sorghum* kasirin gene, the rye secalin gene). Other promoters include those described by Broun et al. (1998), Potenza et al. (2004), US 20070192902 and US 20030159173. In an embodiment, the seed specific promoter is preferentially expressed in defined parts of the seed such as the cotyledon(s) or the endosperm. Examples of cotyledon specific promoters include, but are not limited to, the FP1 promoter (Ellerstrom et al., 1996), the pea legumin promoter (Perrin et al., 2000), and the bean phytohemagglutnin promoter (Perrin et al., 2000). Examples of endosperm specific promoters include, but are not limited to, the maize zein-1 promoter (Chikwamba et al., 2003), the rice glutelin-1 promoter (Yang et al., 2003), the barley D-hordein promoter (Horvath et al., 2000) and wheat HMW glutenin promoters (Alvarez et al., 2000). In a further embodiment, the seed specific promoter is not expressed, or is only expressed at a low level, in the embryo and/or after the seed germinates.

In another embodiment, the plant storage organ specific promoter is a fruit specific promoter. Examples include, but are not limited to, the tomato polygalacturonase, E8 and Pds promoters, as well as the apple ACC oxidase promoter (for review, see Potenza et al., 2004). In a preferred embodiment, the promoter preferentially directs expression in the edible parts of the fruit, for example the pith of the fruit, relative to the skin of the fruit or the seeds within the fruit.

In an embodiment, the inducible promoter is the *Aspergillus nidulans* alc system. Examples of inducible expression systems which can be used instead of the *Aspergillus nidulans* alc system are described in a review by Padidam (2003) and Corrado and Karali (2009). In another embodiment, the inducible promoter is a safener inducible promoter such as, for example, the maize 1n2-1 or 1n2-2 promoter (Hershey and Stoner, 1991), the safener inducible promoter is the maize GST-27 promoter (Jepson et al., 1994), or the soybean GH2/4 promoter (Ulmasov et al., 1995).

In another embodiment, the inducible promoter is a senescence inducible promoter such as, for example, senescence-inducible promoter SAG (senescence associated gene) 12 and SAG 13 from *Arabidopsis* (Gan, 1995; Gan and Amasino, 1995) and LSC54 from *Brassica napus* (Buchanan- Wollaston, 1994). Such promoters show increased expression at about the onset of senescence of plant tissues, in particular the leaves.

For expression in vegetative tissue leaf-specific promoters, such as the ribulose biphosphate carboxylase (RBCS) promoters, can be used. For example, the tomato RBCS1, RBCS2 and RBCS3A genes are expressed in leaves and light grown seedlings (Meier et al., 1997). A ribulose bisphosphate carboxylase promoters expressed almost exclusively in mesophyll cells in leaf blades and leaf sheaths at high levels, described by Matsuoka et al. (1994), can be used. Another leaf-specific promoter is the light harvesting chlorophyll a/b binding protein gene promoter (see, Shiina et al., 1997). The *Arabidopsis thaliana* myb-related gene promoter (Atmyb5) described by Li et al. (1996), is leaf-specific. The Atmyb5 promoter is expressed in developing leaf trichomes, stipules, and epidermal cells on the margins of young rosette and cauline leaves, and in immature seeds. A leaf promoter identified in maize by Busk et al. (1997), can also be used.

In some instances, for example when LEC2 or BBM is recombinantly expressed, it may be desirable that the transgene is not expressed at high levels. An example of a promoter which can be used in such circumstances is a truncated napin A promoter which retains the seed-specific expression pattern but with a reduced expression level (Tan et al., 2011).

The 5' non-translated leader sequence can be derived from the promoter selected to express the heterologous gene sequence of the polynucleotide of the present invention, or may be heterologous with respect to the coding region of the enzyme to be produced, and can be specifically modified if desired so as to increase translation of mRNA. For a review of optimizing expression of transgenes, see Koziel et al. (1996). The 5' non-translated regions can also be obtained from plant viral RNAs (Tobacco mosaic virus, Tobacco etch virus, Maize dwarf mosaic virus, Alfalfa mosaic virus, among others) from suitable eukaryotic genes, plant genes (wheat and maize chlorophyll a/b binding protein gene leader), or from a synthetic gene sequence. The present invention is not limited to constructs wherein the non-translated region is derived from the 5' non-translated sequence that accompanies the promoter sequence. The leader sequence could also be derived from an unrelated promoter or coding sequence. Leader sequences useful in context of the present invention comprise the maize Hsp70 leader (U.S. Pat. Nos. 5,362,865 and 5,859,347), and the TMV omega element.

The termination of transcription is accomplished by a 3' non-translated DNA sequence operably linked in the expression vector to the polynucleotide of interest. The 3' non-translated region of a recombinant DNA molecule contains a polyadenylation signal that functions in plants to cause the addition of adenylate nucleotides to the 3' end of the RNA. The 3' non-translated region can be obtained from various genes that are expressed in plant cells. The nopaline synthase 3' untranslated region, the 3' untranslated region from pea small subunit Rubisco gene, the 3' untranslated region from soybean 7S seed storage protein gene are commonly used in this capacity. The 3' transcribed, non-translated regions containing the polyadenylate signal of *Agrobacterium* tumor-inducing (Ti) plasmid genes are also suitable.

Recombinant DNA technologies can be used to improve expression of a transformed polynucleotide by manipulating, for example, the efficiency with which the resultant transcripts are translated by codon optimisation according to the host cell species or the deletion of sequences that destabilize transcripts, and the efficiency of post-translational modifications.

Transfer Nucleic Acids

Transfer nucleic acids can be used to deliver an exogenous polynucleotide to a cell and comprise one, preferably two, border sequences and one or more polynucleotides of interest. The transfer nucleic acid may or may not encode a selectable marker. Preferably, the transfer nucleic acid forms part of a binary vector in a bacterium, where the binary vector further comprises elements which allow replication of the vector in the bacterium, selection, or maintenance of bacterial cells containing the binary vector. Upon transfer to a eukaryotic cell, the transfer nucleic acid component of the binary vector is capable of integration into the genome of the eukaryotic cell or, for transient expression experiments, merely of expression in the cell.

As used herein, the term "extrachromosomal transfer nucleic acid" refers to a nucleic acid molecule that is capable of being transferred from a bacterium such as *Agrobacterium* sp., to a plant cell such as a plant leaf cell. An extrachromosomal transfer nucleic acid is a genetic element that is well-known as an element capable of being transferred, with the subsequent integration of a nucleotide sequence contained within its borders into the genome of the recipient cell. In this respect, a transfer nucleic acid is flanked, typically, by two "border" sequences, although in some instances a single border at one end can be used and the second end of the transferred nucleic acid is generated randomly in the transfer process. A polynucleotide of interest is typically positioned between the left border-like sequence and the right border-like sequence of a transfer nucleic acid. The polynucleotide contained within the transfer nucleic acid may be operably linked to a variety of different promoter and terminator regulatory elements that facilitate its expression, that is, transcription and/or translation of the polynucleotide. Transfer DNAs (T-DNAs) from *Agrobacterium* sp. such as *Agrobacterium tumefaciens* or *Agrobacterium rhizogenes*, and man made variants/mutants thereof are probably the best characterized examples of transfer nucleic acids. Another example is P-DNA ("plant-DNA") which comprises T-DNA border-like sequences from plants.

As used herein, "T-DNA" refers to a T-DNA of an *Agrobacterium tumefaciens* Ti plasmid or from an *Agrobacterium rhizogenes* Ri plasmid, or variants thereof which function for transfer of DNA into plant cells. The T-DNA may comprise an entire T-DNA including both right and left border sequences, but need only comprise the minimal sequences required in cis for transfer, that is, the right T-DNA border sequence. The T-DNAs of the invention have inserted into them, anywhere between the right and left border sequences (if present), the polynucleotide of interest. The sequences encoding factors required in trans for transfer of the T-DNA into a plant cell such as vir genes, may be inserted into the T-DNA, or may be present on the same replicon as the T-DNA, or preferably are in trans on a compatible replicon in the *Agrobacterium* host. Such "binary vector systems" are well known in the art. As used herein, "P-DNA" refers to a transfer nucleic acid isolated from a plant genome, or man made variants/mutants thereof, and comprises at each end, or at only one end, a T-DNA border-like sequence.

As used herein, a "border" sequence of a transfer nucleic acid can be isolated from a selected organism such as a plant or bacterium, or be a man made variant/mutant thereof. The border sequence promotes and facilitates the transfer of the polynucleotide to which it is linked and may facilitate its integration in the recipient cell genome. In an embodiment, a border-sequence is between 10-80 bp in length. Border sequences from T-DNA from *Agrobacterium* sp. are well known in the art and include those described in Lacroix et al. (2008).

Whilst traditionally only *Agrobacterium* sp. have been used to transfer genes to plants cells, there are now a large number of systems which have been identified/developed which act in a similar manner to *Agrobacterium* sp. Several non-*Agrobacterium* species have recently been genetically modified to be competent for gene transfer (Chung et al., 2006; Broothaerts et al., 2005). These include *Rhizobium* sp. NGR234, *Sinorhizobium meliloti* and *Mezorhizobium loti*.

As used herein, the terms "transfection", "transformation" and variations thereof are generally used interchangeably. "Transfected" or "transformed" cells may have been manipulated to introduce the polynucleotide(s) of interest, or may be progeny cells derived therefrom.

Plants

The invention also provides a plant or part thereof comprising two or more exogenous polynucleotides and/or genetic modifications as described herein. The term "plant" when used as a noun refers to whole plants, whilst the term "part thereof" refers to plant organs (e.g., leaves, stems, roots, flowers, fruit), single cells (e.g., pollen), seed, seed parts such as an embryo, endosperm, scutellum or seed coat, plant tissue such as vascular tissue, plant cells and progeny of the same. As used herein, plant parts comprise plant cells.

As used herein, the terms "in a plant" and "in the plant" in the context of a modification to the plant means that the modification has occurred in at least one part of the plant, including where the modification has occurred throughout the plant, and does not exclude where the modification occurs in only one or more but not all parts of the plant. For example, a tissue-specific promoter is said to be expressed "in a plant", even though it might be expressed only in certain parts of the plant. Analogously, "a transcription factor polypeptide that increases the expression of one or more glycolytic and/or fatty acid biosynthetic genes in the plant" means that the increased expression occurs in at least a part of the plant.

As used herein, the term "plant" is used in it broadest sense, including any organism in the Kingdom Plantae. It also includes red and brown algae as well as green algae. It includes, but is not limited to, any species of flowering plant, grass, crop or cereal (e.g., oilseed, maize, soybean), fodder or forage, fruit or vegetable plant, herb plant, woody plant or tree. It is not meant to limit a plant to any particular structure. It also refers to a unicellular plant (e.g., microalga). The term "part thereof" in reference to a plant refers to a plant cell and progeny of same, a plurality of plant cells, a structure that is present at any stage of a plant's development, or a plant tissue. Such structures include, but are not limited to, leaves, stems, flowers, fruits, nuts, roots, seed, seed coat, embryos. The term "plant tissue" includes differentiated and undifferentiated tissues of plants including those present in leaves, stems, flowers, fruits, nuts, roots, seed, for example, embryonic tissue, endosperm, dermal tissue (e.g., epidermis, periderm), vascular tissue (e.g., xylem, phloem), or ground tissue (comprising parenchyma, collenchyma, and/or sclerenchyma cells), as well as cells in culture (e.g., single cells, protoplasts, callus, embryos, etc.). Plant tissue may be in planta, in organ culture, tissue culture, or cell culture.

As used herein, the term "vegetative tissue" or "vegetative plant part" is any plant tissue, organ or part other than organs for sexual reproduction of plants. The organs for sexual reproduction of plants are specifically seed bearing organs, flowers, pollen, fruits and seeds. Vegetative tissues and parts include at least plant leaves, stems (including bolts and tillers but excluding the heads), tubers and roots, but excludes flowers, pollen, seed including the seed coat, embryo and endosperm, fruit including mesocarp tissue, seed-bearing pods and seed-bearing heads. In one embodiment, the vegetative part of the plant is an aerial plant part. In another or further embodiment, the vegetative plant part is a green part such as a leaf or stem.

A "transgenic plant" or variations thereof refers to a plant that contains a transgene not found in a wild-type plant of the same species, variety or cultivar. Transgenic plants as defined in the context of the present invention include plants and their progeny which have been genetically modified using recombinant techniques to cause production of at least one polypeptide defined herein in the desired plant or part thereof. Transgenic plant parts has a corresponding meaning. The plant and plant parts of the invention may comprise genetic modifications, for example gene mutations, and be considered as "non-transgenic" provided they lack transgenes.

The terms "seed" and "grain" are used interchangeably herein. "Grain" refers to mature grain such as harvested grain or grain which is still on a plant but ready for harvesting, but can also refer to grain after imbibition or germination, according to the context. Mature grain commonly has a moisture content of less than about 18%. In a preferrd embodiment, the moisture content of the grain is at a level which is generally regarded as safe for storage, preferably between 5% and 15%, between 6% and 8%, between 8% and 10%, or between 10% and 15%. "Developing seed" as used herein refers to a seed prior to maturity, typically found in the reproductive structures of the plant after fertilisation or anthesis, but can also refer to such seeds prior to maturity which are isolated from a plant. Mature seed commonly has a moisture content of less than about 12%.

As used herein, the term "plant storage organ" refers to a part of a plant specialized to store energy in the form of for example, proteins, carbohydrates, lipid. Examples of plant storage organs are seed, fruit, tuberous roots, and tubers. A preferred plant storage organ of the invention is seed.

As used herein, the term "phenotypically normal" refers to a genetically modified plant or part thereof, for example a plant such as a tragsenic plant, or a storage organ such as a seed, tuber or fruit of the invention not having a significantly reduced ability to grow and reproduce when compared to an unmodified plant or part thereof. Preferably, the biomass, growth rate, germination rate, storage organ size, seed size and/or the number of viable seeds produced is not less than 90% of that of a plant lacking said genetic modifications or exogenous polynucleotides when grown under identical conditions. This term does not encompass features of the plant which may be different to the wild-type plant but which do not effect the usefulness of the plant for commercial purposes such as, for example, a ballerina phenotype of seedling leaves. In an embodiment, the genetically modified plant or part thereof which is phenotypically normal comprises a recombinant polynucleotide encoding a silencing suppressor operably linked to a plant storage organ specific promoter and has an ability to grow or reproduce which is essentially the same as a corresponding plant or part thereof not comprising said polynucleotide.

Plants go through a series of growing stages from sowing of a seed, germination and emergence of a seedling, through to flowering, seed setting, physiological maturity and ultimately senescence. These stages are well known and readily defined, for example for *Sorghum* plants as follows. Taking the day the seedling first emerges above the soil as day 0, the vegetative stage of growth is defined herein as from 10 days to initiation of flowering at about 60-70 days, and physiological maturity is reached at about 100 days, depending on the environmental conditions. The vegetative stage includes the boot leaf stage from about 45 days until the first flowering. The boot leaf is the last leaf formed on the plant, from which the panicle (head) emerges. The "boot leaf stage" is defined as from when the boot leaf has fully emerged to initiation of flowering.

As used herein, the term "commencement of flowering" or "initiation of flowering" with respect to a plant refers to the time that the first flower on the plant opens, or the time of onset of anthesis.

As used herein, the term "seed set" with respect to a seed-bearing plant refers to the time when the first seed of the plant reaches maturity. This is typically observable by the colour of the seed or its moisture content, well known in the art.

As used herein, the term "mature" as it relates to a plant leaf means that it has reached full size but has not begun to show signs of ageing or death such as yellowing and/or sensensce. The skilled person can readily determine whether a leaf of a particular plant can be considered as mature.

As used herein, the term "senescence" with respect to a whole plant refers to the final stage of plant development which follows the completion of growth, usually after the plant reaches maximum aerial biomass or height. Senescence begins when the plant aerial biomass reaches its maximum and begins to decline in amount and generally ends with death of most of the plant tissues. It is during this stage that the plant mobilises and recycles cellular components from leaves and other parts which accumulated during growth to other parts to complete its reproductive development. Senescence is a complex, regulated process which involves new or increased gene expression of some genes. Often, some plant parts are senescing while other parts of the same plant continue to grow. Therefore, with respect to a plant leaf or other green organ, the term "senescence" as used herein refers to the time when the amount of chlorophyll in the leaf or organ begins to decrease. Senescence is typically associated with dessication of the leaf or organ, mostly in the last stage of senescence. Senescence is usually observable by the change in colour of the leaf from green towards yellow and eventually to brown when fully dessicated. It is believed that cellular senescence underlies plant and organ senescence.

Plants provided by or contemplated for use in the practice of the present invention include both monocotyledons and dicotyledons. In preferred embodiments, the plants of the present invention are crop plants (for example, cereals and pulses, maize, wheat, potatoes, rice, *sorghum*, millet, cassava, barley) or legumes such as soybean, beans or peas. The plants may be grown for production of edible roots, tubers, leaves, stems, flowers or fruit. The plants may be vegetable plants whose vegetative parts are used as food. The plants of the invention may be: *Acrocomia aculeata* (macauba palm), *Arabidopsis thaliana*, *Aracinis hypogaea* (peanut), *Astrocaryum murumuru* (murumuru), *Astrocaryum vulgare* (tucumã), *Attalea geraensis* (Indaiá-rateiro), *Attalea humilis* (American oil palm), *Attalea oleifera* (andaiá), *Attalea phalerata* (uricuri), *Attalea speciosa* (babassu), *Avena sativa* (oats), *Beta vulgaris* (sugar beet), *Brassica* sp. such as *Brassica carinata, Brassica juncea, Brassica napobrassica, Brassica napus* (canola), *Camelina sativa* (false flax), *Cannabis sativa* (hemp), *Carthamus tinctorius* (safflower), *Caryocar brasiliense* (pequi), *Cocos nucifera* (Coconut), *Crambe abyssinica* (Abyssinian kale), *Cucumis melo* (melon), *Elaeis guineensis* (African palm), *Glycine max* (soybean), *Gossypium hirsutum* (cotton), *Helianthus* sp. such as *Helianthus annuus* (sunflower), *Hordeum vulgare* (barley), *Jatropha curcas* (physic nut), *Joannesia princeps* (arara nut-tree), *Lemna* sp. (duckweed) such as *Lemna aequinoctialis, Lemna disperma, Lemna ecuadoriensis, Lemna gibba* (swollen duckweed), *Lemna japonica, Lemna minor, Lemna minuta, Lemna obscura, Lemna paucicostata, Lemna perpusilla, Lemna tenera, Lemna trisulca, Lemna turionifera, Lemna valdiviana, Lemna yungensis, Licania rigida* (oiticica), *Linum usitatissimum* (flax), *Lupinus angustifolius* (lupin), *Mauritia flexuosa* (buriti palm), *Maximiliana maripa* (inaja palm), *Miscanthus* sp. such as *Miscanthus* x *giganteus* and *Miscanthus sinensis, Nicotiana* sp. (tabacco) such as *Nicotiana tabacum* or *Nicotiana benthamiana, Oenocarpus bacaba* (bacaba-do-azeite), *Oenocarpus bataua* (patauã), *Oenocarpus distichus* (bacaba-de-leque), *Oryza* sp. (rice) such as *Oryza sativa* and *Oryza glaberrima, Panicum virgatum* (switchgrass), *Paraqueiba paraensis* (mari), *Persea amencana* (avocado), *Pongamia pinnata* (Indian beech), *Populus trichocarpa, Ricinus communis* (castor), *Saccharum* sp. (sugarcane), *Sesamum indicum* (sesame), *Solanum tuberosum* (potato), *Sorghum* sp. such as *Sorghum bicolor, Sorghum vulgare, Theobroma grandiforum* (cupuassu), *Trifolium* sp., *Trithrinax brasiliensis* (Brazilian needle palm), *Triticum* sp. (wheat) such as *Triticum aestivum, Zea mays* (corn), alfalfa (*Medicago sativa*), rye (*Secale cerale*), sweet potato (*Lopmoea batatus*), cassava (*Manihot esculenta*), coffee (*Cofea* spp.), pineapple (*Anana comosus*), citris tree (*Citrus* spp.), cocoa (*Theobroma cacao*), tea (*Camellia senensis*), banana (*Musa* spp.), avocado (*Persea americana*), fig (*Ficus casica*), guava (*Psidium guajava*), mango (*Mangifer indica*), olive (*Olea europaea*), papaya (*Carica papaya*), cashew (*Anacardium occidentale*), macadamia (*Macadamia intergrifolia*) and almond (*Prunus amygdalus*).

In an embodiment, the plant is not a *Nicotiana* sp.

Other preferred plants include C4 grasses such as, in addition to those mentioned above, *Andropogon gerardi, Bouteloua curtipendula, B. gracilis, Buchloe dactyloides, Schizachyrium scoparium, Sorghastrum nutans, Sporobolus cryptandrus;* C3 grasses such as *Elymus canadensis,* the legumes *Lespedeza capitata* and *Petalostemum villosum,* the forb *Aster azureus;* and woody plants such as *Quercus ellipsoidalis* and *Q. macrocarpa*. Other preferred plants include C3 grasses.

In a preferred embodiment, the plant is an angiosperm.

In an embodiment, the plant is an oilseed plant, preferably an oilseed crop plant. As used herein, an "oilseed plant" is a plant species used for the commercial production of lipid from the seeds of the plant. The oilseed plant may be, for example, oil-seed rape (such as canola), maize, sunflower, safflower, soybean, *sorghum*, flax (linseed) or sugar beet. Furthermore, the oilseed plant may be other Brassicas, cotton, peanut, poppy, rutabaga, mustard, castor bean, sesame, safflower, *Jatropha curcas* or nut producing plants. The plant may produce high levels of lipid in its fruit such as olive, oil palm or coconut. Horticultural plants to which the present invention may be applied are lettuce, endive, or vegetable Brassicas including cabbage, broccoli, or cauliflower. The present invention may be applied in tobacco, cucurbits, carrot, strawberry, tomato, or pepper.

In a preferred embodiment, the plant is a member of the family Fabaceae (or Leguminosae) such as alfalfa, clover, peas, lucerne, beans, lentils, lupins, mesquite, carob, soybeans, and peanuts, or a member of the family Poaceae such as corn, *sorghum*, wheat, barley and oats. In a particularly preferred embodiment, the plant is alfalfa, clover, corn or *sorghum*, each of which are particularly useful for forage or fodder for animals.

In a preferred embodiment, the transgenic plant is homozygous for each and every gene that has been introduced (transgene) so that its progeny do not segregate for the desired phenotype. The transgenic plant may also be heterozygous for the introduced transgene(s), preferably uniformly heterozygous for the transgene such as for example, in F1 progeny which have been grown from hybrid seed. Such plants may provide advantages such as hybrid vigour, well known in the art.

Transformation of Plants

Transgenic plants can be produced using techniques known in the art, such as those generally described in Slater et al., Plant Biotechnology—The Genetic Manipulation of Plants, Oxford University Press (2003), and Christou and Klee, Handbook of Plant Biotechnology, John Wiley and Sons (2004).

As used herein, the terms "stably transforming", "stably transformed" and variations thereof refer to the integration of the polynucleotide into the genome of the cell such that they are transferred to progeny cells during cell division without the need for positively selecting for their presence. Stable transformants, or progeny thereof, can be identified by any means known in the art such as Southern blots on chromosomal DNA, or in situ hybridization of genomic DNA, enablimg their selection.

*Agrobacterium*-mediated transfer is a widely applicable system for introducing genes into plant cells because DNA can be introduced into cells in whole plant tissues, plant organs, or explants in tissue culture, for either transient expression, or for stable integration of the DNA in the plant cell genome. For example, floral-dip (in planta) methods may be used. The use of *Agrobacterium*-mediated plant integrating vectors to introduce DNA into plant cells is well known in the art. The region of DNA to be transferred is defined by the border sequences, and the intervening DNA (T-DNA) is usually inserted into the plant genome. It is the method of choice because of the facile and defined nature of the gene transfer.

Acceleration methods that may be used include for example, microprojectile bombardment and the like. One example of a method for delivering transforming nucleic acid molecules to plant cells is microprojectile bombardment. This method has been reviewed by Yang et al., Particle Bombardment Technology for Gene Transfer, Oxford Press, Oxford, England (1994). Non-biological particles (microprojectiles) that may be coated with nucleic acids and delivered into cells, for example of immature embryos, by a propelling force. Exemplary particles include those comprised of tungsten, gold, platinum, and the like.

In another method, plastids can be stably transformed. Methods disclosed for plastid transformation in higher plants include particle gun delivery of DNA containing a selectable marker and targeting of the DNA to the plastid genome through homologous recombination (U.S. Pat. Nos. 5,451,513, 5,545,818, 5,877,402, 5,932,479, and WO 99/05265). Other methods of cell transformation can also be used and include but are not limited to the introduction of DNA into plants by direct DNA transfer into pollen, by direct injection of DNA into reproductive organs of a plant, or by direct injection of DNA into the cells of immature embryos followed by the rehydration of desiccated embryos.

The regeneration, development, and cultivation of plants from single plant protoplast transformants or from various transformed explants is well known in the art (Weissbach et al., In: Methods for Plant Molecular Biology, Academic Press, San Diego, Calif., (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polynucleotide is cultivated using methods well known to one skilled in the art.

To confirm the presence of the transgenes in transgenic cells and plants, a polymerase chain reaction (PCR) amplification or Southern blot analysis can be performed using methods known to those skilled in the art. Expression products of the transgenes can be detected in any of a variety of ways, depending upon the nature of the product, and include Northern blot hybridisation, Western blot and enzyme assay. Once transgenic plants have been obtained, they may be grown to produce plant tissues or parts having the desired phenotype. The plant tissue or plant parts, may be harvested, and/or the seed collected. The seed may serve as a source for growing additional plants with tissues or parts having the desired characteristics. Preferably, the vegetative plant parts are harvested at a time when the yield of non-polar lipids are at their highest. In one embodiment, the vegetative plant parts are harvested about at the time of flowering, or after flowering has initiated. Preferably, the plant parts are harvested at about the time senescence begins, usually indicated by yellowing and drying of leaves.

Transgenic plants formed using *Agrobacterium* or other transformation methods typically contain a single genetic locus on one chromosome. Such transgenic plants can be referred to as being hemizygous for the added gene(s). More preferred is a transgenic plant that is homozygous for the added gene(s), that is, a transgenic plant that contains two added genes, one gene at the same locus on each chromosome of a chromosome pair. A homozygous transgenic plant can be obtained by self-fertilising a hemizygous transgenic plant, germinating some of the seed produced and analyzing the resulting plants for the gene of interest.

It is also to be understood that two different transgenic plants that contain two independently segregating exogenous genes or loci can also be crossed (mated) to produce offspring that contain both sets of genes or loci. Selfing of appropriate F1 progeny can produce plants that are homozygous for both of the exogenous genes or loci. Back-crossing to a parental plant and out-crossing with a non-transgenic plant are also contemplated, as is vegetative propagation. Similarly, a transgenic plant can be crossed with a second plant comprising a genetic modification such as a mutant gene and progeny containing both of the transgene and the genetic modification identified. Descriptions of other breeding methods that are commonly used for different traits and crops can be found in Fehr, In: Breeding Methods for Cultivar Development, Wilcox J. ed., American Society of Agronomy, Madison Wis. (1987).

Tilling

In one embodiment, TILLING (Targeting Induced Local Lesions IN Genomes) can be used to produce plants in which endogenous genes comprise a mutation, for example genes encoding an SDP1 or TGD polypeptide, TST, a plastidial GPAT, plastidial LPAAT, phosphatidic acid phosphatase (PAP), or a combination of two or more thereof. In a first step, introduced mutations such as novel single base pair changes are induced in a population of plants by treating seeds (or pollen) with a chemical mutagen, and then advancing plants to a generation where mutations will be stably inherited. DNA is extracted, and seeds are stored from all members of the population to create a resource that can be accessed repeatedly over time. For a TILLING assay, heteroduplex methods using specific endonucleases can be used to detect single nucleotide polymorphisms (SNPs). Alternatively, Next Generation Sequencing of DNA from pools of mutagenised plants can be used to identify mutants in the gene of choice. Typically, a mutation frequency of one mutant per 1000 plants in the mutagenised population is achieved. Using this approach, many thousands of plants can be screened to identify any individual with a single base change as well as small insertions or deletions (1-30 bp) in any gene or specific region of the genome. TILLING is further described in Slade and Knauf (2005), and Henikoff et al. (2004).

In addition to allowing efficient detection of mutations, high-throughput TILLING technology is ideal for the detection of natural polymorphisms. Therefore, interrogating an unknown homologous DNA by heteroduplexing to a known sequence reveals the number and position of polymorphic sites. Both nucleotide changes and small insertions and deletions are identified, including at least some repeat number polymorphisms. This has been called Ecotilling (Comai et al., 2004).

Genome Editing Using Site-Specific Nucleases

Genome editing uses engineered nucleases such as RNA guided DNA endonucleases or nucleases composed of sequence specific DNA binding domains fused to a non-specific DNA cleavage module. These engineered nucleases enable efficient and precise genetic modifications by inducing targeted DNA double stranded breaks that stimulate the cell's endogenous cellular DNA repair mechanisms to repair the induced break. Such mechanisms include, for example, error prone non-homologous end joining (NHEJ) and homology directed repair (HDR).

In the presence of donor plasmid with extended homology arms, HDR can lead to the introduction of single or multiple transgenes to correct or replace existing genes. In the absence of donor plasmid, NHEJ-mediated repair yields small insertion or deletion mutations of the target that cause gene disruption.

Engineered nucleases useful in the methods of the present invention include zinc finger nucleases (ZFNs), transcription activator-like (TAL) effector nucleases (TALEN) and CRISPR/Cas9 type nucleases, and related nucleases.

Typically nuclease encoded genes are delivered into cells by plasmid DNA, viral vectors or in vitro transcribed mRNA.

A zinc finger nuclease (ZFN) comprises a DNA-binding domain and a DNA-cleavage domain, wherein the DNA binding domain is comprised of at least one zinc finger and is operatively linked to a DNA-cleavage domain. The zinc finger DNA-binding domain is at the N-terminus of the protein and the DNA-cleavage domain is located at the C-terminus of said protein.

A ZFN must have at least one zinc finger. In a preferred embodiment, a ZFN would have at least three zinc fingers in order to have sufficient specificity to be useful for targeted genetic recombination in a host cell or organism. Typically, a ZFN having more than three zinc fingers would have progressively greater specificity with each additional zinc finger.

The zinc finger domain can be derived from any class or type of zinc finger. In a particular embodiment, the zinc finger domain comprises the $Cis_2His_2$ type of zinc finger that is very generally represented, for example, by the zinc finger transcription factors TFIIIA or Sp1. In a preferred embodiment, the zinc finger domain comprises three $Cis_2His_2$ type zinc fingers. The DNA recognition and/or the binding specificity of a ZFN can be altered in order to accomplish targeted genetic recombination at any chosen site in cellular DNA. Such modification can be accomplished using known molecular biology and/or chemical synthesis techniques. (see, for example, Bibikova et al., 2002).

The ZFN DNA-cleavage domain is derived from a class of non-specific DNA cleavage domains, for example the DNA-cleavage domain of a Type II restriction enzyme such as FokI (Kim et al., 1996). Other useful endonucleases may include, for example, HhaI, HindIII, Nod, BbvCI, EcoRI, BglI, and AhwI.

A transcription activator-like (TAL) effector nuclease (TALEN) comprises a TAL effector DNA binding domain and an endonuclease domain.

TAL effectors are proteins of plant pathogenic bacteria that are injected by the pathogen into the plant cell, where they travel to the nucleus and function as transcription factors to turn on specific plant genes. The primary amino acid sequence of a TAL effector dictates the nucleotide sequence to which it binds. Thus, target sites can be predicted for TAL effectors, and TAL effectors can be engineered and generated for the purpose of binding to particular nucleotide sequences.

Fused to the TAL effector-encoding nucleic acid sequences are sequences encoding a nuclease or a portion of a nuclease, typically a nonspecific cleavage domain from a type II restriction endonuclease such as FokI (Kim et al., 1996). Other useful endonucleases may include, for example, HhaI, HindIII, Nod, BbvCI, EcoRI, BglI, and AhwI. The fact that some endonucleases (e.g., FokI) only function as dimers can be capitalized upon to enhance the target specificity of the TAL effector. For example, in some cases each FokI monomer can be fused to a TAL effector sequence that recognizes a different DNA target sequence, and only when the two recognition sites are in close proximity do the inactive monomers come together to create a functional enzyme. By requiring DNA binding to activate the nuclease, a highly site-specific restriction enzyme can be created.

A sequence-specific TALEN can recognize a particular sequence within a preselected target nucleotide sequence present in a cell. Thus, in some embodiments, a target nucleotide sequence can be scanned for nuclease recognition sites, and a particular nuclease can be selected based on the target sequence. In other cases, a TALEN can be engineered to target a particular cellular sequence.

Genome Editing Using Programmable RNA Guided DNA Endonucleases

Distinct from the site-specific nucleases described above, the clustered regulatory interspaced short palindromic repeats (CRISPR)/Cas system provides an alternative to ZFNs and TALENs for inducing targeted genetic alterations, via RNA-guided DNA cleavage.

CRISPR systems rely on CRISPR RNA (crRNA) and transactivating chimeric RNA (tracrRNA) for sequence-specific cleavage of DNA. Three types of CRISPR/Cas systems exist: in type II systems, Cas9 serves as an RNA-guided DNA endonuclease that cleaves DNA upon crRNA-tracrRNA target recognition. CRISPR RNA base pairs with tracrRNA to form a two-RNA structure that guides the Cas9 endonuclease to complementary DNA sites for cleavage.

The CRISPR system can be portable to plant cells by co-delivery of plasmids expressing the Cas endonuclease and the necessary crRNA components. The Cas endonuclease may be converted into a nickase to provide additional control over the mechanism of DNA repair (Cong et al., 2013).

CRISPRs are typically short partially palindromic sequences of 24-40 bp containing inner and terminal inverted repeats of up to 11 bp. Although isolated elements have been detected, they are generally arranged in clusters (up to about 20 or more per genome) of repeated units spaced by unique intervening 20-58 bp sequences. CRISPRs are generally homogenous within a given genome with most of them being identical. However, there are examples of heterogeneity in, for example, the Archaea (Mojica et al., 2000).

Feedstuffs

The present invention includes compositions which can be used as feedstuffs. For purposes of the present invention, "feedstuffs" include any food or preparation for animal (including human) consumption and which serves to nourish or build up tissues or supply energy, and/or to maintain, restore or support adequate nutritional status or metabolic function. Feedstuffs of the invention include nutritional compositions for babies and/or young children.

As used herein, the term "animal" refers to any eukaryotic organism capable of ingesting plant derived material. In an embodiment, the animal is a ruminant animal (cattle, sheep, goats etc). Alternatively, the animal is a non-ruminant animal. In one embodiment, the animal is a mammal. In an embodiment, the animal is a human. In an embodiment, the animal is a livestock animal such, but not limited to, as cattle, goats, sheep, pigs, horses, poultry such as chickens and the like. In an embodiment, the cattle are diary cattle or beef cattle. In another embodiment, the animal is a fish, for instance fish bred using aquaculture including, but not limited to, salmon, trout, carp, bass, bream, turbot, sole, milkfish, grey mullet, grouper, flounder, sea bass, cod, haddock, Japanese flounder, catfish, char, whitefish, sturgeon, tench, roach, pike, pike-perch, yellowtail, tilapia, eel or tropical fish (such as the fresh, brackish, and salt water tropical fish). The animal may be a crustacean such as, but not limited to, krill, clams, shrimp (including prawns), crab, and lobster.

Feedstuffs of the invention may comprise for example, a plant or part thereof such as a vegetative plant part of the invention along with a suitable carrier(s). The term "carrier" is used in its broadest sense to encompass any component which may or may not have nutritional value. As the person skilled in the art will appreciate, the carrier must be suitable for use (or used in a sufficiently low concentration) in a feedstuff, such that it does not have deleterious effect on an organism which consumes the feedstuff. Feedstuffs may comprise plant parts which have been harvested and subsequently processed or treated, for example, by chopping, cutting, drying, pressing or pelleting the plant parts, into a form that is suitable for consumption by the animal, or altered by processes such as drying or fermentation to produce hay or silage.

The feedstuff of the present invention comprises a lipid and/or protein produced directly or indirectly by use of the methods, plants or parts thereof disclosed herein. The composition may either be in a solid or liquid form. Additionally, the composition may include edible macronutrients, vitamins, and/or minerals in amounts desired for a particular use. The amounts of these ingredients will vary depending on whether the composition is intended for use with normal individuals or for use with individuals having specialized needs such as individuals suffering from metabolic disorders and the like.

Examples of suitable carriers with nutritional value include, but are not limited to, macronutrients such as edible fats, carbohydrates and proteins. Examples of such edible fats include, but are not limited to, coconut oil, borage oil, fungal oil, black current oil, soy oil, and mono- and di-glycerides. Examples of such carbohydrates include, but are not limited to, glucose, edible lactose, and hydrolyzed starch. Additionally, examples of proteins which may be utilized in the nutritional composition of the invention include, but are not limited to, soy proteins, electrodialysed whey, electrodialysed skim milk, milk whey, or the hydrolysates of these proteins.

With respect to vitamins and minerals, the following may be added to the feedstuff compositions of the present invention, calcium, phosphorus, potassium, sodium, chloride, magnesium, manganese, iron, copper, zinc, selenium, iodine, and vitamins A, E, D, C, and the B complex. Other such vitamins and minerals may also be added.

A feedstuff composition of the present invention may also be added to food even when supplementation of the diet is not required. For example, the composition may be added to food of any type, including, but not limited to, margarine, butter, cheeses, milk, yogurt, chocolate, candy, snacks, salad oils, cooking oils, cooking fats, meats, fish and beverages.

Additionally, material produced in accordance with the present invention may also be used as animal food supplements to alter an animal's tissue or milk fatty acid composition to one more desirable for human or animal consumption, or to reduce methane production in ruminant animals. Furthermore, feedstuffs of the invention can be used in aquaculture to increase the levels of fatty acids and nutrition in fish for human or animal consumption.

Preferred feedstuffs of the invention are the plants, seed and other plant parts such as leaves, fruits and stems which may be used directly as food or feed for humans or other animals. For example, animals may graze directly on such plants grown in the field, or be fed more measured amounts in controlled feeding. The invention includes the use of such plants and plant parts as feed for increasing the polyunsaturated fatty acid levels in humans and other animals.

For consumption by non-human animals the feedstuff may be in any suitable form for such as, but not limited to, silage, hay or pasture growing in a field. In an embodiment, the feedstuff for non-human consumption is a leguminous plant, or part thereof, which is a member of the family Fabaceae family (or Leguminosae) such as alfalfa, clover, peas, lucerne, beans, lentils, lupins, mesquite, carob, soybeans, and peanuts.

In embodiment, the animal is in a feedlot and/or a shed.

In an embodiment, the plant or fraction thereof comprises at least about 5%, at least about 10%, at least about 50%, at least about 75%, at least about 90% or all of the feedstuff.

Silage

As used herein, "silage" is a relatively high-moisture fodder which has been produced and stored in a process called ensilage and which is typically fed to cattle, sheep or other ruminants. During the storage time, carbohydrates, lipids and proteins in the plant material ferment, producing organic acids, or are broken down oxidatively, or both. The plant material upon harvest and the post-fermentation plant materials are both included in silage as the term is used herein. Silage is typically made from grass crops such as maize, *sorghum*, oats or other cereals, or from mixed pasture grasses and legumes such as alfalfa or clover, using the green, above-ground parts of the plants. Silage is made either by placing cut vegetation (usually the whole above-ground plant biomass which can include reproductive tissues) in a pit or silo or other means for storage, and compressing it down so as to leave as little air as possible with the plant material. Oxygen is excluded to some extent by covering it with a plastic sheet or by wrapping the plant material tightly within plastic film (baling) to reduce air inflow. Silage is made from plant material with a suitable moisture content, generally about 50% to 60% of the fresh weight, depending on the means of storage and the degree of compression used and the amount of water that will be lost in storage, but not exceeding 75%. For *sorghum* and corn, harvest begins when the whole-plant moisture is at a suitable level, ideally a few days before it is ripe. For pasture-type crops, the plants are mowed and allowed to wilt for a day or so until the moisture content drops to a suitable level. Ideally the crop is mowed when in full flower and deposited in the pit or silo on the day of its cutting. At harvesting, or after, the plant material is shredded or chopped by the harvester into pieces typically about 1-5 cm long. The plant material may be placed in large heaps on the ground and compressed to reduce the amount of air, then covered with plastic, or into a silo. Alternatively, the plant material may be baled in plastic wrapping to exclude air, which typically requires a lower moisture content of about 30-40%, but still too damp to be stored as dry hay.

The cut or chopped, stored plant material undergoes mostly anaerobic fermentation, which starts about 48 hours after the pit or silo is filled. The fermentation process converts sugars and other carbohydrates such as hemicellulose to organic acids, mostly acetic, propionic, lactic and butyric acids. Fermentation starts after the trapped oxygen is consumed and is essentially complete after about two weeks of storage, or may continue for longer periods. When the plant material is closely packed, the supply of oxygen is limited and the fermentation results in the decomposition of the carbohydrates, some lipids and proteins in the material into the organic acids. This product is named sour silage. If, on the other hand, the fodder is more loosely packed, the main reaction is oxidation which proceeds more rapidly and the temperature rises. If the mass is compressed when the temperature is 60-75 C, the reaction ceases and sweet silage results. Fermentation may be aided by inoculation with specific microorganisms such as lactic acid bacteria to speed fermentation or improve the resulting silage, e.g. with *Lactobacillus plantarum*.

Bulk silage is commonly fed to dairy cattle, while baled silage tends to be used for beef cattle, sheep and horses. The advantages of silage as animal feed are several. During fermentation, the silage bacteria act on the cellulose and other carbohydrates in the forage to produce the organic fatty acids, thereby lowering the pH. This inhibits competing bacteria that might cause spoilage and the organic acids thereby act as natural preservatives, improve digestibility and palatability. This preservative action is particularly important during winter in temperate regions, when green forage is unavailable.

Silage can be produced using techniques known in the art such as those described in CN 101940272 CN 103461658 CN 101946853, CN 101946853, CN 104381743, U.S. Pat. Nos. 3,875,304 and 6,224,916. Pellets for animal feed can be produced using techniques known in the art such as those described in U.S. Pat. Nos. 3,035,920, 3,573,924 and 5,871,802.

Plant Biomass

An increase in the total lipid content of plant biomass equates to greater energy content, making its use as a feed or forage or in the production of biofuel more economical.

The main components of naturally occurring plant biomass are carbohydrates (approximately 75%, dry weight) and lignin (approximately 25%), which can vary with plant type. The carbohydrates are mainly cellulose or hemicellulose fibers, which impart strength to the plant structure, and lignin, which holds the fibers together. Plant biomass typically has a low energy density as a result of both its physical form and moisture content. This also makes it inconvenient and inefficient for storage and transport without some kind of pre-processing. There are a range of processes available to convert it into a more convenient form including: 1) physical pre-processing (for example, grinding) or 2) conversion by thermal (for example, combustion, gasification, pyrolysis) or chemical (for example, anaerobic digestion, fermentation, composting, transesterification) processes. In this way, the biomass is converted into what can be described as a biomass fuel.

Combustion

Combustion is the process by which flammable materials are allowed to burn in the presence of air or oxygen with the release of heat. The basic process is oxidation. Combustion is the simplest method by which biomass can be used for energy, and has been used to provide heat. This heat can itself be used in a number of ways: 1) space heating, 2) water (or other fluid) heating for central or district heating or process heat, 3) steam raising for electricity generation or motive force. When the flammable fuel material is a form of biomass the oxidation is of predominantly the carbon (C) and hydrogen (H) in the cellulose, hemicellulose, lignin, and other molecules present to form carbon dioxide ($CO_2$) and water ($H_2O$). The plants of the invention provide improved fuel for combustion by virtue of the increased lipid content.

Gasification

Gasification is a partial oxidation process whereby a carbon source such as plant biomass, is broken down into carbon monoxide (CO) and hydrogen ($14_2$), plus carbon dioxide ($CO_2$) and possibly hydrocarbon molecules such as methane ($CH_4$). If the gasification takes place at a relatively low temperature, such as 700° C. to 1000° C., the product gas will have a relatively high level of hydrocarbons compared to high temperature gasification. As a result it may be used directly, to be burned for heat or electricity generation via a steam turbine or, with suitable gas clean up, to run an internal combustion engine for electricity generation. The combustion chamber for a simple boiler may be close coupled with the gasifier, or the producer gas may be cleaned of longer chain hydrocarbons (tars), transported, stored and burned remotely. A gasification system may be closely integrated with a combined cycle gas turbine for electricity generation (IGCC—integrated gasification combined cycle). Higher temperature gasification (1200° C. to 1600° C.) leads to few hydrocarbons in the product gas, and a higher proportion of CO and $H_2$. This is known as synthesis gas (syngas or biosyngas) as it can be used to synthesize longer chain hydrocarbons using techniques such as Fischer-Tropsch (FT) synthesis. If the ratio of $H_2$ to CO is correct (2:1) FT synthesis can be used to convert syngas into high quality synthetic diesel biofuel which is compatible with conventional fossil diesel and diesel engines.

Pyrolysis

As used herein, the term "pyrolysis" means a process that uses slow heating in the absence of oxygen to produce gaseous, oil and char products from biomass. Pyrolysis is a thermal or thermo-chemical conversion of lipid-based, particularly triglyceride-based, materials. The products of pyrolysis include gas, liquid and a sold char, with the proportions of each depending upon the parameters of the process. Lower temperatures (around 400° C.) tend to produce more solid char (slow pyrolysis), whereas somewhat higher temperatures (around 500° C.) produce a much higher proportion of liquid (bio-oil), provided the vapour residence time is kept down to around is or less. Temperatures of about 275° C. to about 375° C. can be used to produce liquid bio-oil having a higher proportion of longer chain hydrocarbons. Pyrolysis involves direct thermal cracking of the lipids or a combination of thermal and catalytic cracking. At temperatures of about 400-500° C., cracking occurs, producing short chain hydrocarbons such as alkanes, alkenes, alkadienes, aromatics, olefins and carboxylic acid, as well as carbon monoxide and carbon dioxide.

Four main catalyst types can be used including transition metal catalysts, molecular sieve type catalysts, activated alumina and sodium carbonate (Maher et al., 2007). Examples are given in U.S. Pat. No. 4,102,938. Alumina ($Al_2O_3$) activated by acid is an effective catalyst (U.S. Pat. No. 5,233,109). Molecular sieve catalysts are porous, highly crystalline structures that exhibit size selectivity, so that molecules of only certain sizes can pass through. These include zeolite catalysts such as ZSM-5 or HZSM-5 which are crystalline materials comprising $A1O_4$ and $SiO_4$ and other silica-alumina catalysts. The activity and selectivity of these catalysts depends on the acidity, pore size and pore shape, and typically operate at 300-500° C. Transition metal catalysts are described for example in U.S. Pat. No. 4,992,605. Sodium carbonate catalyst has been used in the pyrolysis of oils (Dandik and Aksoy, 1998).

As used herein, "hydrothermal processing", "HTP", also referred to as "thermal depolymerisation" is a form of pyrolysis which reacts the plant-derived matter, specifically the carbon-containing material in the plant-derived matter, with hydrogen to produce a bio-oil product comprised predominantly of paraffinic hydrocarbons along with other gases and solids. A significant advantage of HTP is that the vegetative plant material does not need to be dried before forming the composition for the conversion reaction, although the vegetative plant material can be dried beforehand to aid in transport or storage of the biomass. The biomass can be used directly as harvested from the field. The reactor is any vessel which can withstand the high temperature and pressure used and is resistant to corrosion. The solvent used in the HTP includes water or is entirely water, or may include some hydrocarbon compounds in the form of an oil. Generally, the solvent in HTP lacks added alcohols. The conversion reaction may occur in an oxidative, reductive or inert environment. "Oxidative" as used herein means in the presence of air, "reductive" means in the presence of a reducing agent, typically hydrogen gas or methane, for example 10-15% $H_2$ with the remainder of the gas being $N_2$, and "inert" means in the presence of an inert gas such as nitrogen or argon. The conversion reaction is preferably carried out under reductive conditions. The carbon-containing materials that are converted include cellulose, hemicellulose, lignin and proteins as well as lipids. The process uses a conversion temperature of between 270° C. and 400° C. and a pressure of between 70 and 350 bar, typically 300° C. to 350° C. and a pressure between 100-170 bar. As a result of the process, organic vapours, pyrolysis gases and charcoal are produced. The organic vapours are condensed to produce the bio-oil. Recovery of the bio-oil may be achieved by cooling the reactor and reducing the pressure to atmospheric pressure, which allows bio-oil (organic) and water phases to develop and the bio-oil to be removed from the reactor.

The yield of the recovered bio-oil is calculated as a percentage of the dry weight of the input biomass on a dry weight basis. It is calculated according to the formula: weight of bio-oil×100/dry weight of the vegetative plant parts. The weight of the bio-oil does not include the weight of any water or solids which may be present in a bio-oil mixture, which are readily removed by filtration or other known methods.

The bio-oil may then be separated into fractions by fractional distillation, with or without additional refining processes. Typically, the fractions that condense at these temperatures are termed: about 370° C., fuel oil; about 300° C., diesel oil; about 200° C., kerosene; about 150° C., gasoline (petrol). Heavier fractions may be cracked into lighter, more desirable fractions, well known in the art. Diesel fuel typically is comprised of C13-C22 hydrocarbon compounds.

Transesterification

"Transesterification" as used herein is the conversion of lipids, principally triacylglycerols, into fatty acid methyl esters or ethyl esters by reaction with short chain alcohols such as methanol or ethanol, in the presence of a catalyst such as alkali or acid. Methanol is used more commonly due to low cost and availability, but ethanol, propanol or butanol or mixtures of the alcohols can also be used. The catalysts may be homogeneous catalysts, heterogeneous catalysts or enzymatic catalysts. Homogeneous catalysts include ferric sulphate followed by KOH. Heterogeneous catalysts include CaO, $K_3PO_4$, and $WO_3/ZrO_2$. Enzymatic catalysts include Novozyme 435 produced from *Candida antarctica*.

Transesterification can be carried out on extracted oil, or preferably directly in situ in the vegetative plant material. The vegetative plant parts may be dried and milled prior to being used to prepare the composition for the conversion reaction, but does not need to be. The advantage of direct conversion to fatty acid esters, preferably FAME, is that the conversion can use lower temperatures and pressures and still provide good yields of the product, for example, comprising at least 50% FAME by weight. The yield of recovered bio-oil by transesterification is calculated as for the HTP process.

Production of Non-Polar Lipids

Techniques that are routinely practiced in the art can be used to extract, process, purify and analyze the lipids such as the TAG produced by plants or parts thereof of the instant invention. Such techniques are described and explained throughout the literature in sources such as, Fereidoon Shahidi, Current Protocols in Food Analytical Chemistry, John Wiley & Sons, Inc. (2001) D1.1.1-D1.1.11, and Perez-Vich et al. (1998).

Production of Oil from Vegetative Plant Parts or Seed

Typically, vegetative plant parts or plant seeds are cooked, pressed, and/or extracted to produce crude vegetative oil or seedoil, which is then degummed, refined, bleached, and deodorized. Generally, techniques for crushing seed are known in the art. For example, oilseeds can be tempered by spraying them with water to raise the moisture content to, for example, 8.5%, and flaked using a smooth roller with a gap setting of 0.23 to 0.27 mm. Depending on the type of seed, water may not be added prior to crushing. Application of heat deactivates enzymes, facilitates further cell rupturing, coalesces the lipid droplets, and agglomerates protein particles, all of which facilitate the extraction process. Vegetative plant parts can be similarly treated, depending on the moisture content.

In an embodiment, the majority of the vegetative oil or seedoil is released by passage through a screw press. Cakes (vegetative plant meal, seedmeal) expelled from the screw press may then be solvent extracted for example, with hexane, using a heat traced column, or not be solvent treated, in which case it may be more suitable as animal feed. Alternatively, crude vegetative oil or seedoil produced by the pressing operation can be passed through a settling tank with a slotted wire drainage top to remove the solids that are expressed with the vegetative oil or seedoil during the pressing operation. The clarified vegetative oil or seedoil can be passed through a plate and frame filter to remove any remaining fine solid particles. Once the solvent is stripped from the crude oil, the pressed and extracted portions are combined and subjected to normal lipid processing procedures (i.e., degumming, caustic refining, bleaching, and deodorization).

Extraction of the lipid from vegetative plant parts of the invention uses analogous methods to those known in the art for seedoil extraction. One way is physical extraction, which often does not use solvent extraction. Expeller pressed extraction is a common type, as are the screw press and ram press extraction methods. Mechanical extraction is typically less efficient than solvent extraction where an organic solvent (e.g., hexane) is mixed with at least the plant biomass, preferably after the biomass is dried and ground. The solvent dissolves the lipid in the biomass, which solution is then separated from the biomass by mechanical action (e.g., with the pressing processes above). This separation step can also be performed by filtration (e.g., with a filter press or similar device) or centrifugation etc. The organic solvent can then be separated from the non-polar lipid (e.g., by distillation). This second separation step yields non-polar lipid from the plant and can yield a re-usable solvent if one employs conventional vapor recovery. In an embodiment, the oil and/or protein content of the plant part or seed is analysed by near-infrared reflectance spectroscopy as described in Hom et al. (2007) prior to extraction.

If the vegetative plant parts are not to be used immediately to extract the lipid it is preferably processed to ensure the lipid content is retained as much as possible (see, for example, Christie, 1993), such as by drying the vegetative plant parts.

Degumming

Degumming is an early step in the refining of oils and its primary purpose is the removal of most of the phospholipids from the oil, which may be present as approximately 1-2% of the total extracted lipid. Addition of ~2% of water, typically containing phosphoric acid, at 70-80° C. to the crude oil results in the separation of most of the phospholipids accompanied by trace metals and pigments. The insoluble material that is removed is mainly a mixture of phospholipids and triacylglycerols and is also known as lecithin. Degumming can be performed by addition of concentrated phosphoric acid to the crude oil to convert non-hydratable phosphatides to a hydratable form, and to chelate minor metals that are present. Gum is separated from the oil by centrifugation. The oil can be refined by addition of a sufficient amount of a sodium hydroxide solution to titrate all of the fatty acids and removing the soaps thus formed.

Alkali Refining

Alkali refining is one of the refining processes for treating crude oil, sometimes also referred to as neutralization. It usually follows degumming and precedes bleaching. Following degumming, the oil can treated by the addition of a sufficient amount of an alkali solution to titrate all of the fatty acids and phosphoric acids, and removing the soaps thus formed. Suitable alkaline materials include sodium hydroxide, potassium hydroxide, sodium carbonate, lithium hydroxide, calcium hydroxide, calcium carbonate and ammonium hydroxide. This process is typically carried out at room temperature and removes the free fatty acid fraction. Soap is removed by centrifugation or by extraction into a solvent for the soap, and the neutralised oil is washed with water. If required, any excess alkali in the oil may be neutralized with a suitable acid such as hydrochloric acid or sulphuric acid.

Bleaching

Bleaching is a refining process in which oils are heated at 90-120° C. for 10-30 minutes in the presence of a bleaching earth (0.2-2.0%) and in the absence of oxygen by operating with nitrogen or steam or in a vacuum. This step in oil processing is designed to remove unwanted pigments (carotenoids, chlorophyll, gossypol etc), and the process also removes oxidation products, trace metals, sulphur compounds and traces of soap.

Deodorization

Deodorization is a treatment of oils and fats at a high temperature (200-260° C.) and low pressure (0.1-1 mm Hg). This is typically achieved by introducing steam into the oil at a rate of about 0.1 ml/minute/100 ml of oil. Deodorization can be performed by heating the oil to 260° C. under vacuum, and slowly introducing steam into the oil at a rate of about 0.1 ml/minute/100 ml of oil. After about 30 minutes of sparging, the oil is allowed to cool under vacuum. The oil is typically transferred to a glass container and flushed with argon before being stored under refrigeration. If the amount of oil is limited, the oil can be placed under vacuum for example, in a Parr reactor and heated to 260° C. for the same length of time that it would have been deodorized. This treatment improves the colour of the oil and removes a majority of the volatile substances or odorous compounds including any remaining free fatty acids, monoacylglycerols and oxidation products.

Winterisation

Winterization is a process sometimes used in commercial production of oils for the separation of oils and fats into solid (stearin) and liquid (olein) fractions by crystallization at sub-ambient temperatures. It was applied originally to cottonseed oil to produce a solid-free product. It is typically used to decrease the saturated fatty acid content of oils.

Algae

Algae can produce 10 to 100 times as much mass as terrestrial plants in a year and can be cultured in open-ponds (such as raceway-type ponds and lakes) or in photobioreactors. The most common oil-producing algae can generally include the diatoms (bacillariophytes), green algae (chlorophytes), blue-green algae (cyanophytes), and golden-brown algae (chrysophytes). In addition a fifth group known as haptophytes may be used. Groups include brown algae and heterokonts. Specific non-limiting examples algae include the Classes: Chlorophyceae, Eustigmatophyceae, Prymnesiophyceae, Bacillariophyceae. Bacillariophytes capable of oil production include the genera Amphipleura, Amphora, Chaetoceros, Cyclotella, Cymbella, Fragilaria, Hantzschia, Navicula, *Nitzschia, Phaeodactylum,* and *Thalassiosira.* Specific non-limiting examples of chlorophytes capable of oil production include Ankistrodesmus, *Botryococcus, Chlorella, Chlorococcum, Dunaliella,* Monoraphidium, Oocystis, *Scenedesmus,* and *Tetraselmis.* In one aspect, the chlorophytes can be *Chlorella* or *Dunaliella.* Specific non-limiting examples of cyanophytes capable of oil production include Oscillatoria and Synechococcus. A specific example of chrysophytes capable of oil production includes Boekelovia. Specific non-limiting examples of haptophytes include Isochysis and Pleurochysis.

Specific algae useful in the present invention include, for example, *Chlamydomonas* sp. such as *Chlamydomonas reinhardtii, Dunaliella* sp. such as *Dunaliella salina, Dunaliella tertiolecta, D. acidophila, D. Lateralis. D. martima. D. parva, D. polmorpha, D. primolecta, D. pseudosalina, D. quartolecta. D. viridis, Haematococcus* sp., *Chlorella* sp. such as *Chlorella vulgaris, Chlorella sorokiniana* or *Chlorella* protothecoides, Thraustochytrium sp., Schizochytrium sp., Volvox sp, *Nannochloropsis* sp., *Botryococcus braunii* which can contain over 60 wt % lipid, *Phaeodactylum tricornutum, Thalassiosira pseudonana, Isochrysis* sp., *Pavlova* sp., Chlorococcum sp, Elhpsoidion sp., *Neochloris* sp., *Scenedesmus* sp.

Algae of the invention can be harvested using microscreens, by centrifugation, by flocculation (using for example, chitosan, alum and ferric chloride) and by froth flotation. Interrupting the carbon dioxide supply can cause algae to flocculate on its own, which is called "autoflocculation". In froth flotation, the cultivator aerates the water into a froth, and then skims the algae from the top. Ultrasound and other harvesting methods are currently under development.

Lipid may be extracted from the algae by mechanical crushing. When algal mass is dried it retains its lipid content, which can then be "pressed" out with an oil press. Osmotic shock may also be used to release cellular components such as lipid from algae, and ultrasonic extraction can accelerate extraction processes. Chemical solvents (for example, hexane, benzene, petroleum ether) are often used in the extraction of lipids from algae. Enzymatic extraction using enzymes to degrade the cell walls may also be used to extract lipids from algae. Supercritical $CO_2$ can also be used as a solvent. In this method, $CO_2$ is liquefied under pressure and heated to the point that it becomes supercritical (having properties of both a liquid and a gas), allowing it to act as a solvent.

Uses of Plant Lipids

The lipids produced by the methods described have a variety of uses. In some embodiments, the lipids are used as food oils. In other embodiments, the lipids are refined and used as lubricants or for other industrial uses such as the synthesis of plastics. In some preferred embodiments, the lipids are refined to produce biodiesel. Biodiesel can be made from oils derived from the plants, algae and fungi of the invention. Use of plant triacylglycerols for the production of biofuel is reviewed in Durrett et al. (2008). The resulting fuel is commonly referred to as biodiesel and has a dynamic viscosity range from 1.9 to 6.0 $mm^2s^{-1}$ (ASTM D6751). Bioalcohol may produced from the fermentation of sugars or the biomass other than the lipid left over after lipid extraction. General methods for the production of biofuel can be found in, for example, Maher and Bressler (2007), Greenwell et al. (2010), Karmakar et al. (2010), Alonso et al. (2010), Liu et al. (2010a). Gong and Jiang (2011), Endalew et al. (2011) and Semwal et al. (2011).

The present invention provides methods for increasing oil content in vegetative tissues. Plants of the present invention have increased energy content of leaves and/or stems such that the whole above-ground plant parts may be harvested and used to produce biofuel. Furthermore, the level of oleic acid is increased significantly while the polyunsaturated fatty acid alpha linolenic acid (ALA) was reduced. The plants, algae and fungi of the present invention thereby reduce the production costs of biofuel.

Biodiesel

The production of biodiesel, or alkyl esters, is well known. There are three basic routes to ester production from lipids: 1) Base catalysed transesterification of the lipid with alcohol; 2) Direct acid catalysed esterification of the lipid with methanol; and 3) Conversion of the lipid to fatty acids, and then to alkyl esters with acid catalysis. Any method for preparing fatty acid alkyl esters and glyceryl ethers (in which one, two or three of the hydroxy groups on glycerol are etherified) can be used. For example, fatty acids can be prepared, for example, by hydrolyzing or saponifying TAG with acid or base catalysts, respectively, or using an enzyme such as a lipase or an esterase. Fatty acid alkyl esters can be prepared by reacting a fatty acid with an alcohol in the presence of an acid catalyst. Fatty acid alkyl esters can also be prepared by reacting TAG with an alcohol in the presence of an acid or base catalyst. Glycerol ethers can be prepared, for example, by reacting glycerol with an alkyl halide in the presence of base, or with an olefin or alcohol in the presence of an acid catalyst. The alkyl esters can be directly blended with diesel fuel, or washed with water or other aqueous solutions to remove various impurities, including the catalysts, before blending.

Aviation Fuel

For improved performance of biofuels, thermal and catalytic chemical bond-breaking (cracking) technologies have been developed that enable converting bio-oils into bio-based alternatives to petroleum-derived diesel fuel and other fuels, such as jet fuel.

The use of medium chain fatty acid source, such produced by a cell of the invention, a plant or part thereof of the invention, a seed of of the invention, or a transgenic version of any one thereof, precludes the need for high-energy fatty acid chain cracking to achieve the shorter molecules needed for jet fuels and other fuels with low-temperature flow requirements. This method comprises cleaving one or more medium chain fatty acid groups from the glycerides to form glycerol and one or more free fatty acids. In addition, the method comprises separating the one or more medium chain fatty acids from the glycerol, and decarboxylating the one or more medium chain fatty acids to form one or more hydrocarbons for the production of the jet fuel.

Compositions

The present invention also encompasses compositions, particularly pharmaceutical compositions, comprising one or more plants, plant parts, lipids, proteins, nitrogen containing molecules, or carbon containing molecules, produced using the methods of the invention.

A pharmaceutical composition may additionally comprise an active ingredient and a standard, well-known, non-toxic pharmaceutically-acceptable carrier, adjuvant or vehicle such as phosphate-buffered saline, water, ethanol, polyols, vegetable oils, a wetting agent, or an emulsion such as a water/oil emulsion. The composition may be in either a liquid or solid form. For example, the composition may be in the form of a tablet, capsule, ingestible liquid, powder, topical ointment or cream. Proper fluidity can be maintained for example, by the maintenance of the required particle size in the case of dispersions and by the use of surfactants. It may also be desirable to include isotonic agents for example, sugars, sodium chloride, and the like. Besides such inert diluents, the composition can also include adjuvants such as wetting agents, emulsifying and suspending agents, sweetening agents, flavoring agents and perfuming agents.

A typical dosage of a particular fatty acid is from 0.1 mg to 20 g, taken from one to five times per day (up to 100 g daily) and is preferably in the range of from about 10 mg to about 1, 2, 5, or 10 g daily (taken in one or multiple doses). As known in the art, a minimum of about 300 mg/day of fatty acid, especially polyunsaturated fatty acid, is desirable. However, it will be appreciated that any amount of fatty acid will be beneficial to the subject.

Possible routes of administration of the pharmaceutical compositions of the present invention include for example, enteral and parenteral. For example, a liquid preparation may be administered orally. Additionally, a homogenous mixture can be completely dispersed in water, admixed under sterile conditions with physiologically acceptable diluents, preservatives, buffers or propellants to form a spray or inhalant.

The dosage of the composition to be administered to the subject may be determined by one of ordinary skill in the art and depends upon various factors such as weight, age, overall health, past history, immune status, etc., of the subject.

Additionally, the compositions of the present invention may be utilized for cosmetic purposes. The compositions may be added to pre-existing cosmetic compositions, such that a mixture is formed, or a fatty acid produced according to the invention may be used as the sole "active" ingredient in a cosmetic composition.

Polypeptides

The terms "polypeptide" and "protein" are generally used interchangeably herein.

A polypeptide or class of polypeptides may be defined by the extent of identity (% identity) of its amino acid sequence to a reference amino acid sequence, or by having a greater % identity to one reference amino acid sequence than to another. The % identity of a polypeptide to a reference amino acid sequence is typically determined by GAP analysis (Needleman and Wunsch, 1970; GCG program) with parameters of a gap creation penalty=5, and a gap extension penalty=0.3. The query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns two sequences over their entire length, and the extent of identity is determined over the full length of the reference sequence. The polypeptide or class of polypeptides may have the same enzymatic activity as, or a different activity than, or lack the activity of, the reference polypeptide. Preferably, the polypeptide has an enzymatic activity of at least 10% of the activity of the reference polypeptide.

As used herein a "biologically active fragment" is a portion of a polypeptide of the invention which maintains a defined activity of a full-length reference polypeptide for example, DGAT activity. Biologically active fragments as used herein exclude the full-length polypeptide. Biologically active fragments can be any size portion as long as they maintain the defined activity. Preferably, the biologically active fragment maintains at least 10% of the activity of the full length polypeptide.

With regard to a defined polypeptide or enzyme, it will be appreciated that % identity figures higher than those provided herein will encompass preferred embodiments. Thus, where applicable, in light of the minimum % identity figures, it is preferred that the polypeptide/enzyme comprises an amino acid sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

Amino acid sequence mutants of the polypeptides defined herein can be prepared by introducing appropriate nucleotide changes into a nucleic acid defined herein, or by in vitro synthesis of the desired polypeptide. Such mutants include for example, deletions, insertions, or substitutions of residues within the amino acid sequence. A combination of deletions, insertions and substitutions can be made to arrive at the final construct, provided that the final polypeptide product possesses the desired characteristics.

Mutant (altered) polypeptides can be prepared using any technique known in the art, for example, using directed evolution or rathional design strategies (see below). Products derived from mutated/altered DNA can readily be screened using techniques described herein to determine if they possess transcription factor, fatty acid acyltransferase or OBC activities.

In designing amino acid sequence mutants, the location of the mutation site and the nature of the mutation will depend on characteristic(s) to be modified. The sites for mutation can be modified individually or in series for example, by (1) substituting first with conservative amino acid choices and then with more radical selections depending upon the results achieved, (2) deleting the target residue, or (3) inserting other residues adjacent to the located site.

Amino acid sequence deletions generally range from about 1 to 15 residues, more preferably about 1 to 10 residues and typically about 1 to 5 contiguous residues.

Substitution mutants have at least one amino acid residue in the polypeptide removed and a different residue inserted in its place. The sites of greatest interest for substitutional mutagenesis to inactivate enzymes include sites identified as the active site(s). Other sites of interest are those in which particular residues obtained from various strains or species are identical. These positions may be important for biological activity. These sites, especially those falling within a sequence of at least three other identically conserved sites, are preferably substituted in a relatively conservative manner. Such conservative substitutions are shown in Table 1 under the heading of "exemplary substitutions".

TABLE 1

Exemplary substitutions.

| Original Residue | Exemplary Substitutions |
| --- | --- |
| Ala (A) | val; leu; ile; gly |
| Arg (R) | lys |
| Asn (N) | gln; his |
| Asp (D) | glu |
| Cys (C) | ser |
| Gln (Q) | asn; his |
| Glu (E) | asp |
| Gly (G) | pro, ala |
| His (H) | asn; gln |
| Ile (I) | leu; val; ala |
| Leu (L) | ile; val; met; ala; phe |
| Lys (K) | arg |
| Met (M) | leu; phe |
| Phe (F) | leu; val; ala |
| Pro (P) | gly |
| Ser (S) | thr |
| Thr (T) | ser |
| Trp (W) | tyr |
| Tyr (Y) | trp; phe |
| Val (V) | ile; leu; met; phe, ala |

In a preferred embodiment a mutant/variant polypeptide has only, or not more than, one or two or three or four conservative amino acid changes when compared to a naturally occurring polypeptide. Details of conservative amino acid changes are provided in Table 1. As the skilled person would be aware, such minor changes can reasonably be predicted not to alter the activity of the polypeptide when expressed in a transgenic plant or part thereof. Mutants with desired activity may be engineered using standard procedures in the art such as by performing random mutagenesis, targeted mutagenesis, or saturation mutagenesis on known genes of interest, or by subjecting different genes to DNA shuffling.

EXAMPLES

Example 1. General Materials and Methods

Expression of Genes in Plant Cells in a Transient Expression System

Genes were expressed in plant cells using a transient expression system essentially as described by Voinnet et al. (2003) and Wood et al. (2009). Binary vectors containing the coding region to be expressed by a strong constitutive e35S promoter containing a duplicated enhancer region were introduced into Agrobacterium tumefaciens strain AGL1. A chimeric binary vector, 35S:p19, for expression of the p19 viral silencing suppressor was separately introduced into AGL1, as described in WO2010/057246. A chimeric binary vector, 35S:V2, for expression of the V2 viral silencing suppressor was separately introduced into AGL1. The recombinant cells were grown to stationary phase at 28° C. in LB broth supplemented with 50 mg/L kanamycin and 50 mg/L rifampicin. The bacteria were then pelleted by centrifugation at 5000 g for 5 min at room temperature before being resuspended to OD600=1.0 in an infiltration buffer containing 10 mM MES pH 5.7, 10 mM $MgCl_2$ and 100 uM acetosyringone. The cells were then incubated at 28° C. with shaking for 3 hours after which the OD600 was measured and a volume of each culture, including the viral suppressor construct 35S:p19 or 35S:V2, required to reach a final concentration of OD600=0.125 added to a fresh tube. The final volume was made up with the above buffer. Leaves were then infiltrated with the culture mixture and the plants were typically grown for a further three to five days after infiltration before leaf discs were recovered for either purified cell lysate preparation or total lipid isolation.

Transformation of Sorghum bicolor L.

Plant Material

Sorghum plants of the inbred cultivar TX-430 (Miller, 1984) were grown in a plant growth chamber (Conviron, PGC-20 flex) at 28±1° C. "day" temperature and 20±1° C. "night" temperature, with a 16 hr photoperiod at a light intensity during the "day" of 900-1000 LUX. Panicles were covered with white translucent paper bags before flowering. Immature embryos were harvested from panicles 12-15 days after anthesis. Panicles were washed several times with water and developing seeds that were uniform in size were isolated and surface-sterilized using 20% commercial bleach mixed with 0.1% Tween-20 for 15-20 min. They were then washed with sterile distilled water 3 times each for 20 min, and blotted dry in a laminar flow hood. Immature embryos (IEs) ranging from 1.4 to 2.5 mm in length were aseptically isolated in the laminar flow hood and used as the starting tissue for preparation of green regenerative tissue.

Base Cultivation Media

Media used for plant transformation were based on MS (Murashige and Skoog, 1962), supplied by PhytoTechnology Laboratories (M519). The pH of the media was adjusted to 5.8 before sterilization at 121° C. for 15 min. Heat sensitive plant growth regulators and other additives such as Geneticin (G418, Sigma) used as a selection agent, were filter sterilized (0.2 μm) and added to the media after sterilization when the media had cooled to about 55° C. The optimized culture medium composition for the different stages of plant transformation from callus induction to plant regeneration from green tissue induced from immature embryos is presented in Table 2.

Cultivation Methods and Materials

The isolated IEs ranging from 1.4 to 2.5 mm in length were placed onto callus induction media-osmotic medium (CIM-osmotic medium, Table 2) with their scutellum facing upward. The CIM base medium was modified to improve callus quality and induction frequency from immature embryos, as well as callus regeneration media, by including α-Lipoic acid (1 to 5 mg/l), Melatonin (5 to 10 mg/l) and 2-Aminoidan-2-phosphonic acid HCl (1 to 2 mg/l) unless otherwise stated. For the development of green tissue, immature embryos were incubated under fluorescent light of approximately 45-50 μmol $s^{-1}$ $m^{-2}$ (16 h/day) in a tissue culture room at 24±2° C. After three days of culture, the root and shoot poles of the immature embryos were aseptically separated and re-inoculated on to the same CIM and maintained under the same conditions as described above. They were subcultured every two weeks onto the same CIM for 6 weeks and evaluated for callus quality, callus induction efficiency and transformation efficiency.

Callus initiated from IEs in the first 3-4 weeks on CIM were mostly embryogenic and slowly differentiated into embryogenic callus with nodular structures which were coloured from pale to darker green. Embryogenic calli with green nodular structures were selected and maintained on the same medium (CIM) by subculturing every 2 weeks for up to 6 months or more, for use as explants for transformation. This type of tissue is termed herein as "differentiating embryogenic callus" tissue or "DEC" tissue, since this tissue forms nodular structures of differentiating cells which maintain embryogenic and organogenic potential, even though the tissues were really a mixture of callus cells, cells forming nodular structures and granular structures, and intermediate cells which the inventors understood were on the developmental pathway somewhere between callus (which is undifferentiated cells) and the nodular structures. Sometimes, the tissues included early stage (globular) somatic embryos.

control of a pUbi promoter and terminated with an *Agrobacterium* nopaline synthase 3' regulatory sequence (nos 3'). The uidA/bar vector was initially used in experiments to detect transient gene expression in the *sorghum* DEC tissues.

TABLE 2

Media used in DEC tissue induction and transformation of sorghum

| Name of the medium | Composition | Culture duration |
|---|---|---|
| CIM-Osmotic Medium | MS medium powder with vitamins, 4.33 g/l; 2,4-D, 1 mg/l; BAP, 0.5 mg/l; L-proline, 0.7 g/l; L-Lipoic acid, 1 mg/l; peptone, 0.82 g/l; Myo-inositol, 150 mg/l; Copper sulfate, 0.8 mg/l; Manitol, 36.4 g/l; Sorbitol, 36.4 g/l; Agar, 8.5 g/l, pH 5.8 | 3-4 hrs before bombardment; o/n post bombardment |
| CIM- pre selection medium | MS medium powder with vitamins, 4.33 g/l; 2,4-D, 1 mg/l; BAP, 0.5 mg/l; L-proline, 0.7 g/l; L-Lipoic acid, 1 mg/l; peptone, 0.82 g/l; Myo-inosito, l 150 mg/l; Copper sulfate, 0.8 mg/l; Maltose, 30 g/l; L-cysteine, 50 mg/l; Ascorbic acid, 15 mg/l; Agar, 9 g/l, pH 5.8 | 3-4 days |
| CIM-callus induction medium/G25 | MS medium powder with vitamins, 4.33 g/l; 2,4-D, 1 mg/l; BAP, 0.5 mg/l; L-proline, 0.7 g/l; L-Lipoic acid, 1 mg/l; peptone, 0.82 g/l; Myo-inositol, 150 mg/l; Copper sulfate, 0.8 mg/l; Maltose, 30 g/l; Geneticin, 25 mg/l; Agar, 9 g/l, pH 5.8 | 4 weeks |
| SIM-shoot induction medium/G25 | MS medium powder with vitamins, 4.33 g/l; BAP, 1.0 mg/l; 2,4-D, 0.5 mg/l; L-proline, 0.7 g/l; L-Lipoic acid, 1 mg/l; peptone, 0.82 g/l; Myo-inositol, 150 mg/l; Copper sulfate, 0.8 mg/l; Maltose, 30 g/l; Geneticin, 25 mg/l; Agar, 9 g/l, pH 5.8 | 2 weeks |
| SRM- shoot regeneration medium/G25 | MS medium powder with vitamins, 4.33 g/l; BAP, 1.0 mg/l; TDZ, 0.5 mg/l; L-proline, 0.7 g/l; L-Lipoic acid, 1 mg/l; peptone, 0.82 g/l; Myo-inositol, 150 mg/l; Copper sulfate, 0.8 mg/l; Maltose, 30 g/l; Geneticin, 25 mg/l; Agar, 9 g/l, pH 5.8 | 2 weeks |
| SOG-shoot out growth medium/G30 | MS medium powder with vitamins, 2.2 g/l; L-proline, 0.7 g/l; L-Lipoic acid, 1 mg/l; peptone, 0.82 g/l; Myo-inositol, 150 mg/l; Copper sulfate, 0.8 mg/l; Sucrose, 15 g/l; Geneticin, 30 mg/l; Agar, 9 g/l, pH 5.8 | 2 weeks |
| RIM-root induction medium/G15 | MS medium powder with vitamins, 4.33 g/l; L-proline, 0.7 g/l; L-Lipoic acid, 1 mg/l; peptone, 0.82 g/l; Myo-inositol, 150 mg/l; Copper sulfate, 0.8 mg/l; sucrose, 15 g/l; IAA, 1 mg/l; IBA, 1 mg/l; NAA, 1 mg/l; PVP, 2 g/l; Geneticin, 15 mg/l; Agar 9 g/l, pH 5.8 | 4 weeks |

Particle-Bombardment of Green Regenerative DEC Tissues

Plasmids containing a selectable marker gene encoding the neomycin phosphotransferase II (NptII) providing resistance to the antibiotic Geneticin, under the control of the pUbi promoter and terminated by the nos 3' region, were made or obtained for experiments to achieve stable transformation or for co-bombardment with other plasmids. Plasmid DNAs were isolated using a Zymopure™ Maxiprep kit (USA) according to the manufacturer's instructions. As a control vector for transformation, a genetic vector was obtained which contained uidA (GUS) and bar genes designed for expression in plant cells. The uidA gene was under the regulatory control of a maize polyubiquitin promoter (pUbi) and an *Agrobacterium tumefaciens* octopine synthase polyadenylation/terminator (ocs 3') sequence. The sequence between the promoter and the protein coding region included the 5' UTR and first intron of the Ubi gene. The uidA reporter gene also contained, within its protein coding region, an intron from a castor bean catalase gene which prevented translation of functional GUS protein in *Agrobacterium*, thereby reducing the background GUS gene expression in inoculated plant tissues. Therefore, any GUS expression would be due to expression of the uidA gene in the plant cells. The bar gene was also under the regulatory Uniform healthy, green regenerative DEC tissues (4-5 mm in size), produced using methods described above and having been cultured for 6 weeks to 6 months from initiation, were used for microprojectile-mediated transformation (bombardment) with the plasmids. Approximately 15 uniform green DEC tissues (each 4-5 mm) were placed at the centre of a petri dish (90 mm diameter) containing CIM-osmotic medium (Table 2) and incubated in the dark for about 4 hrs prior to bombardment. Bombardment was performed with a PDS-1000 He device (Biorad, Hercules, Calif.) as described by Liu et al. (2014). Post bombardment, the tissues were kept on the same osmotic medium overnight and transferred to pre-selection medium the next morning Green DEC tissues bombarded with the genetic vector plasmid having a selectable marker encoding NptII were transferred to CIM-PS medium for 3-4 days before any selection, with addition to the medium of two compounds as antioxidants, L-cysteine (50 mg/1) and ascorbic acid (15 mg/1) (Table 2). Without the addition of these antioxidants in pre-selection medium, many of the bombarded tissues turned brown, some quite dark brown in colour, and many lost any ability to grow further. After 3-4 days on pre-selection medium, some of the bombarded tissues were subjected to GUS staining and viewed under a microscope to count the distinctive blue (GUS positive) spots, to check that genes had been transferred and could be expressed. The inclusion of the two antioxidants in the pre-selection medium improved the efficiency of the transformation as shown by the transient expression of the GUS gene.

Selection and Regeneration of Transgenic Plants with Optimised Conditions

Following bombardment and 3-4 days culture on pre-selection medium without selective agent (Geneticin), the bombarded tissues had increased in size from 4-5 mm to about 6-7 mm. These tissues were transferred to selective medium CIM/G25 containing 25 mg/l Geneticin (Table 2) and cultured for a further 4 weeks. When possible, the bombarded tissues were split into 2-6 pieces each, increasing the recovery of independent transformants. All of the tissues were cultured on the media as described in Table 2 and maintained in order to regenerate putative transgenic plants.

Plants were regenerated efficiently upon growth on these media. Each bombarded tissue and the shoots obtained from it were subcultured and maintained separately for calculation of the transformation efficiency. Positive transformation was confirmed by PCR on plant genomic DNA isolated from shoot samples, showing the presence of the selectable marker gene. The number of transformants was calculated per input DEC tissue. Transformation efficiencies of about 50% were obtained, expressed as independent transformants per input bombarded tissue.

Agrobacterium-Mediated Transformation of Green Regenerative DEC Tissues

Uniform healthy, green regenerative DEC tissues (4-5 mm in size) produced using methods described in the foregoing examples and which have been cultured for 6 weeks to 6 months from initiation, are used for Agrobacterium-mediated transformation.

Genetic vectors having T-DNA regions containing the genes for transformation were designed and made for transformation of green regenerative DEC tissues using Agrobacterium-mediated transformation. A control binary vector contained uidA (GUS) and bar genes designed for expression in plant cells. The uidA gene was under the regulatory control of a maize polyubiquitin promoter (pUbi) and an Agrobacterium tumefaciens octopine synthase polyadenylation/terminator (ocs 3') sequence. The sequence between the promoter and the protein coding region included the 5' UTR and first intron of the Ubi gene. The uidA reporter gene also contained, within its protein coding region, an intron from a castor bean catalase gene which prevented translation of functional GUS protein in Agrobacterium, thereby reducing the background GUS gene expression in inoculated plant tissues. Therefore, any GUS expression was due to expression of the uidA gene in the plant cells. The bar gene was also under the regulatory control of a pUbi promoter and terminated with an Agrobacterium nopaline synthase 3' regulatory sequence (nos 3').

A suitable Agrobacterium tumefaciens strain was obtained e.g., AGL1 as described in Lazo et al. (1991) and the genetic vector is introduced into the Agrobacterium tumefaciens strain by heat shock method.

Agrobacterium cultures harboring the genetic construct are grown in suitable medium e.g., LB medium, and under appropriate conditions to produce an Agrobacterium inoculum, after which time the uniform healthy, green regenerative DEC tissues are infected with Agrobacterium inoculum. The infected DEC tissues are blotted on sterile filter paper to remove excess Agrobacterium and transferred to co-cultivation medium, optionally supplemented with antioxidants, and incubated in the dark at approximately 22-24° C. for 2-4 days. Following incubation, the DEC tissues are treated with an appropriate agent to kill the Agrobacterium, washed in sterile water, transferred to an appropriate medium and allowed to grow. After 4-6 weeks, shoots are excised and cultured on shoot elongation medium, after which time putative transgenic shoots are then detected using appropriate assays.

Brassica napus Transformation

Brassica napus seeds were sterilized using chlorine gas as described by Kereszt et al. (2007) and germinated on tissue culture medium. Cotyledonary petioles with 2-4 mm stalk were isolated as described by Belide et al. (2013) and used as explants. A. tumefaciens AGL1 (Lazo et al., 1991) cultures containing the binary vector were prepared and cotyledonary petioles inoculated with the cultures as described by Belide et al. (2013). Infected cotyledonary petioles were cultured on MS medium supplemented with 1 mg/L TDZ+0.1 mg/L NAA+3 mg/L AgNO$_3$+250 mg/L cefotaxime, 50 mg/L timentin and 25 mg/L kanamycin and cultured for 4 weeks at 24° C. with 16 hr/8 hr light-dark photoperiod with a biweekly subculture on to the same medium. Explants with green callus were transferred to shoot initiation medium (MS+1 mg/L kinetin+3 mg/L AgNO$_3$+250 mg/L cefotaxime+50 mg/L timentin+25 mg/L kanamycin) and cultured for another 2-3 weeks. Small shoots (~1 cm) were isolated from the resistant callus and transferred to shoot elongation medium (MS medium with 0.1 mg/L gibberelic acid+3 mg/L AgNO$_3$+250 mg/L cefotaxime+25 mg/L kanamycin) and cultured for another two weeks. Healthy shoots with one or two leaves were selected and transferred to rooting media (½ MS with 1 mg/L NAA+20 mg/L ADS+3 mg/L AgNO$_3$+250 mg/L cefotaxime) and cultured for 2-3 weeks. DNA was isolated from small leaves of resistant shoots using the plant DNA isolation kit (Bioline, Alexandria, NSW, Australia) as described by the manufacturer's protocol. The presence of T-DNA sequences was tested by PCR amplification on genomic DNA. Positive, transgenic shoots with roots were transferred to pots containing seedling raising mix and grown in a glasshouse at 24° C. daytime/16° C. night-time (standard conditions).

Purified Leaf Lysate—Enzyme Assays

Nicotiana benthamiana leaf tissues previously infiltrated as described above were ground in a solution containing 0.1 M potassium phosphate buffer (pH 7.2) and 0.33 M sucrose using a glass homogenizer. Leaf homogenate was centrifuged at 20,000 g for 45 minutes at 4° C. after which each supernatant was collected. Protein content in each supernatant was measured according to Bradford (1976) using a Wallac1420 multi-label counter and a Bio-Rad Protein Assay dye reagent (Bio-Rad Laboratories, Hercules, Calif. USA). Acyltransferase assays used 100 µg protein according to Cao et al. (2007) with some modifications. The reaction medium contained 100 mM Tris-HCl (pH 7.0), 5 mM MgCl$_2$, 1 mg/mL BSA (fatty acid-free), 200 mM sucrose, 40 mM cold oleoyl-CoA, 16.4 µM sn-2 monooleoylglycerol [$^{14}$C] (55mCi/mmol, American Radiochemicals, Saint Louis, Mo. USA) or 6.0 µM [$^{14}$C]glycerol-3-phosphate (G-3-P) disodium salt (150 mCi/mmol, American Radiochemicals). The assays were carried out for 7.5, 15, or 30 minutes.

Lipid Analysis

Analysis of Oil Content in Seeds

When seed oil content or total fatty acid composition was to be determined in small seeds such as Arabidopsis seeds, fatty acids in the seeds were directly methylated without crushing of seeds. Seeds were dried in a desiccator for 24 hours and approximately 4 mg of seed was transferred to a 2 ml glass vial containing a Teflon-lined screw cap. 0.05 mg triheptadecanoin (TAG with three C17:0 fatty acids) dissolved in 0.1 ml toluene was added to the vial as internal standard. Seed fatty acids were methylated by adding 0.7 ml of 1N methanolic HCl (Supelco) to the vial containing seed material. Crushing of the seeds was not necessary for complete methylation with small seeds such as *Arabidopsis* seeds. The mixture was vortexed briefly and incubated at 80° C. for 2 hours. After cooling the mixtures to room temperature, 0.3 ml of 0.9% NaCl (w/v) and 0.1 ml hexane was added to the vial and mixed well for 10 minutes in a Heidolph Vibramax 110. The FAME were collected into a 0.3 ml glass insert and analysed by GC with a flame ionization detector (FID) as described below.

The peak area of individual FAME were first corrected on the basis of the peak area responses of a known amount of the same FAMEs present in a commercial standard GLC-411 (NU-CHEK PREP, INC., USA). GLC-411 contains equal amounts of 31 fatty acids (% by weight), ranging from C8:0 to C22:6. In case of fatty acids which were not present in the standard, the peak area responses of the most similar FAME was taken. For example, the peak area response of FAMEs of 16:1d9 was used for 16:1d7 and the FAME response of C22:6 was used for C22:5. The corrected areas were used to calculate the mass of each FAME in the sample by comparison to the internal standard mass. Oil is stored mainly in the form of TAG and its weight was calculated based on FAME weight. Total moles of glycerol was determined by calculating moles of each FAME and dividing total moles of FAMEs by three. TAG content was calculated as the sum of glycerol and fatty acyl moieties using a relation: % oil by weight=100×((41×total mol FAME/3)+(total g FAME−(15× total mol FAME)))/g seed, where 41 and 15 are molecular weights of glycerol moiety and methyl group, respectively.

Analysis of Fatty Acid Content in Larger Seeds

To determine fatty acid composition in single seeds that were larger, such as canola and *Camelina* seeds, or *Sorghum* or corn seeds, direct methylation of fatty acids in the seed was performed as for *Arabidopsis* seeds except with breaking of the seed coats. This method extracted sufficient oil from the seed to allow fatty acid composition analysis. To determine the fatty acid composition of total extracted lipid from seeds, seeds were crushed and lipids extracted with $CHCl_3$/MeOH. Aliquots of the extracted lipid were methylated and analysed by GC. Pooled seed-total lipid content (seed oil content) of canola was determined by two extractions of lipid using $CHCl_3$/MeOH from a known weight of desiccated seeds after crushing, followed by methylation of aliquots of the lipids together with the 17:0 fatty acids as internal standard. In the case of larger seeds such as *Camelina*, the lipid from a known amount of seeds was methylated together with known amount of 17:0 fatty acids as for the *Arabidopsis* oil analysis and FAME were analysed by GC. For TAG quantitation, TAG was fractionated from the extracted lipid using TLC and directly methylated in silica using 17:0 TAG as an internal standard. These methods are described more fully as follows.

After harvest at plant maturity, seeds were desiccated by storing the seeds for 24 hours at room temperature in a desiccator containing silica gel as desiccant. Moisture content of the seeds was typically 6-8%. Total lipids were extracted from known weights of the desiccated seeds by crushing the seeds using a mixture of chloroform and methanol (2/1 v/v) in an eppendorf tube using a Reicht tissue lyser (22 frequency/seconds for 3 minutes) and a metal ball. One volume of 0.1M KCl was added and the mixture shaken for 10 minutes. The lower non-polar phase was collected after centrifuging the mixture for 5 minutes at 3000 rpm. The remaining upper (aqueous) phase was washed with 2 volumes of chloroform by mixing for 10 minutes. The second non-polar phase was also collected and pooled with the first. The solvent was evaporated from the lipids in the extract under nitrogen flow and the total dried lipid was dissolved in a known volume of chloroform.

To measure the amount of lipid in the extracted material, a known amount of 17:0-TAG was added as internal standard and the lipids from the known amount of seeds incubated in 1 N methanolic-HCl (Supelco) for 2 hours at 80° C. FAME thus made were extracted in hexane and analysed by GC. Individual FAME were quantified on the basis of the amount of 17:0 TAG-FAME. Individual FAME weights, after subtraction of weights of the esterified methyl groups from FAME, were converted into moles by dividing by molecular weights of individual FAME. Total moles of all FAME were divided by three to calculate moles of TAG and therefore glycerol. Then, moles of TAG were converted in to weight of TAG. Finally, the percentage oil content on a seed weight basis was calculated using seed weights, assuming that all of the extracted lipid was TAG or equivalent to TAG for the purpose of calculating oil content. This method was based on Li et al. (2006). Seeds other than *Camelina* or canola seeds that are of a similar size can also be analysed by this method.

Canola and other seed oil content can be measured by nuclear magnetic resonance techniques (Rossell and Pritchard, 1991) by a pulsed wave NMS 100 Minispec (Bruker Pty Ltd Scientific Instruments, Germany). The NMR method can simultaneously measured moisture content. Seed oil content can also be measured by near infrared reflectance (NIR) spectroscopy such as using a NIRSystems Model 5000 monochromator. Moisture content can also be measured on a sample from a batch of seeds by drying the seeds in the sample for 18 hours at about 100° C., according to Li et al. (2006).

Analysis of Lipids from Leaf Lysate Assays

Lipids from the lysate assays were extracted using chloroform:methanol:0.1 M KCl (2:1:1) and recovered. The different lipid classes in the samples were separated on Silica gel 60 thin layer chromatography (TLC) plates (MERCK, Dermstadt, Germany) impregnated with 10% boric acid. The solvent system used to fractionate TAG from the lipid extract was chloroform/acetone (90/10 v/v). Individual lipid classes were visualized by exposing the plates to iodine vapour and identified by running parallel authentic standards on the same TLC plate. The plates were exposed to phosphor imaging screens overnight and analysed by a Fujifilm FLA-5000 phosphorimager before liquid scintillation counting for DPM quantification.

Total Lipid Isolation and Fractionation of Lipids from Vegetative Tissues

Fatty acid composition of total lipid in leaf and other vegetative tissue samples was determined by direct methylation of the fatty acids in freeze-dried samples. For total lipid quantitation, fatty acids in a known weight of freeze-dried samples, with 17:0 FFA, were directly methylated. To determine total TAG levels in leaf samples, TAG was fractionated by TLC from extracted total lipids, and methylated in the presence of 17:0 TAG internal standard, because of the presence of substantial amounts of polar lipids in leaves. This was done as follows. Tissues including leaf samples were freeze-dried, weighed (dry weight) and total lipids extracted as described by Bligh and Dyer (1959)

or by using chloroform:methanol:0.1 M KCl (CMK; 2:1:1) as a solvent. Total lipids were extracted from *N. benthamiana* leaf samples, after freeze dying, by adding 900 μL of a chloroform/methanol (2/1 v/v) mixture per 1 cm diameter leaf sample. 0.8 DAGE was added per 0.5 mg dry leaf weight as internal standard when TLC-FID analysis was to be performed. Samples were homogenized using an IKA ultra-turrax tissue lyser after which 500 μL 0.1 M KCl was added. Samples were vortexed, centrifuged for 5 min and the lower phase was collected. The remaining upper phase was extracted a second time by adding 600 μL chloroform, vortexing and centrifuging for 5 min. The lower phase was recovered and pooled into the previous collection. Lipids were dried under a nitrogen flow and resuspended in 2 μL chloroform per mg leaf dry weight. Total lipids of *N. tabacum* leaves or leaf samples were extracted as above with some modifications. If 4 or 6 leaf discs (each approx 1 cm$^2$ surface area) were combined, 1.6 ml of CMK solvent was used, whereas if 3 or less leaf discs were combined, 1.2 ml CMK was used. Freeze dried leaf tissues were homogenized in an eppendorf tube containing a metallic ball using a Reicht tissue lyser (Qiagen) for 3 minutes at 20 frequency/sec.

Separation of Neutral Lipids Via TLC and Transmethylation

Known volumes of total leaf extracts such as, for example, 30 μL were loaded on a TLC silica gel 60 plate (1×20 cm) (Merck KGaA, Germany). The neutral lipids were fractionated into the different types and separated from polar lipids via TLC in an equilibrated development tank containing a hexane/DEE/acetic acid (70/30/1 v/v/v/) solvent system. The TAG bands were visualised by primuline spraying, marked under UV, scraped from the TLC plate, transferred to 2 mL GC vials and dried with $N_2$. 750 μL of 1N methanolic-HCl (Supelco analytical, USA) was added to each vial together with a known amount of C17:0 TAG as an internal standard, depending on the amount of TAG in each sample. Typically, 30 μg of the internal standard was added for low TAG samples whilst up to 200 μg of internal standard was used in the case of high TAG samples.

Lipid samples for fatty acid composition analysis by GC were transmethylated by incubating the mixtures at 80° C. for 2 hours in the presence of the methanolic-HCl. After cooling samples to room temperature, the reaction was stopped by adding 350 μl $H_2O$. Fatty acyl methyl esters (FAME) were extracted from the mixture by adding 350 μl hexane, vortexing and centrifugation at 1700 rpm for 5 min. The upper hexane phase was collected and transferred into GC vials with 300 μl conical inserts. After evaporation, the samples were resuspended in 30 μl hexane. One μl was injected into the GC.

The amount of individual and total fatty acids (TFA) present in the lipid fractions was quantified by GC by determining the area under each peak and calculated by comparison with the peak area for the known amount of internal standard. TAG content in leaf was calculated as the sum of glycerol and fatty acyl moieties in the TAG fraction using a relation: % TAG by weigh=100×((41×total mol FAME/3)+(total g FAME−(15×total mol FAME)))/g leaf dry weight, where 41 and 15 are molecular weights of glycerol moiety and methyl group, respectively.

Capillary Gas-Liquid Chromatography (GC)

FAME were analysed by GC using an Agilent Technologies 7890A GC (Palo Alto, Calif., USA) equipped with an SGE BPX70 (70% cyanopropyl polysilphenylene-siloxane) column (30 m×0.25 mm i.d., 0.25 μm film thickness), an FID, a split/splitless injector and an Agilent Technologies 7693 Series auto sampler and injector. Helium was used as the carrier gas. Samples were injected in split mode (50:1 ratio) at an oven temperature of 150° C. After injection, the oven temperature was held at 150° C. for 1 min, then raised to 210° C. at 3° C.min$^{-1}$ and finally to 240° C. at 50° C.min$^{-1}$. Peaks were quantified with Agilent Technologies ChemStation software (Rev B.04.03 (16), Palo Alto, Calif., USA) based on the response of the known amount of the external standard GLC-411 (Nucheck) and C17:0-Me internal standard.

Quantification of TAG Via Iatroscan

One μL of lipid extract was loaded on one Chromarod-SII for TLC-FID Iatroscan™ (Mitsubishi Chemical Medience Corporation—Japan). The Chromarod rack was then transferred into an equilibrated developing tank containing 70 mL of a hexane/CHCl$_3$/2-propanol/formic acid (85/10.716/0.567/0.0567 v/v/v/v) solvent system. After 30 min of incubation, the Chromarod rack was dried for 3 min at 100° C. and immediately scanned on an Iatroscan MK-6s TLC-FID analyser (Mitsubishi Chemical Medience Corporation—Japan). Peak areas of DAGE internal standard and TAG were integrated using SIC-48011 integration software (Version: 7.0-E SIC System instruments Co., LTD—Japan).

TAG quantification was carried out in two steps. First, DAGE was scanned in all samples to correct the extraction yields after which concentrated TAG samples were selected and diluted. Next, TAG was quantified in diluted samples with a second scan according to the external calibration using glyceryl trilinoleate as external standard (Sigma-Aldrich).

Quantification of TAG in Leaf Samples by GC

The peak area of individual FAME were first corrected on the basis of the peak area responses of known amounts of the same FAMEs present in a commercial standard GLC-411 (NU-CHEK PREP, Inc., USA). The corrected areas were used to calculate the mass of each FAME in the sample by comparison to the internal standard. Since oil is stored primarily in the form of TAG, the amount of oil was calculated based on the amount of FAME in each sample. Total moles of glycerol were determined by calculating the number of moles of FAMEs and dividing total moles of FAMEs by three. The amount of TAG was calculated as the sum of glycerol and fatty acyl moieties using the formula: % oil by weight=100×((41×total mol FAME/3)+(total g FAME−(15×total mol FAME)))/g leaf dry weight, where 41 and 15 are the molecular weights of glycerol moiety and methyl group, respectively.

Soluble Protein Extraction and Quantitation

Soluble protein was extracted from 10-20 mg ground fresh plant tissue. Briefly, chlorophyll and soluble sugars were extracted at 80° C. in 50-80% (v/v) ethanol in 2.5 mM HEPES buffer at pH 7.5 and the pellet was retained for soluble protein determination. The pellet was washed in distilled water, resuspended in 400 μl 0.1 M NaOH and heated at 95° C. for 30 min. The soluble protein in the supernatant was determined using a Bradford assay (Bradford, 1976). Soluble protein was also extracted from freshly ground tissue in buffer containing 100 mM Tris-HCl pH 8.0 and 10 mM $MgCl_2$. Quantitation of the soluble protein by Bradford assay gave results similar to those obtained using the extraction with NaOH.

SDS-Polyacrylamide Gel Electrophoresis (SDS-PAGE)

Total protein was extracted from frozen, ground leaf tissue by heating the samples in Laemmli buffer (1:3 w/v) at 95° C. for 10 min. Aliquots of the supernatant, normalised to fresh weight (FW), were separated on a 10% acrylamide gel according to Laemmli (1970).

Leaf Nitrogen Content

Total nitrogen content (% dry weight, DW) of 2-2.2 mg freeze-dried leaf tissue was determined using a Europa 20-20 isotope ratio mass spectrometer with an ANCA preparation system, comprising a combustion and reduction tube operating at 1000° C. and 600° C., respectively.

Carbon and Energy Contents

Carbon and energy contents were calculcated based on the amount of TAG, starch and total carbohydrates in wildtype and transgenic leaf tissues (% leaf dry weight). Starch levels (% leaf dry weight) were first converted to glucose equivalents by multiplying by a factor of 180/162 to take into account the loss of water due to chain linkages. Soluble sugars were defined as the difference between the total carbohydrate and starch levels. The carbon and energy contents of TAG and soluble sugars were calculated based on the energy density, molecular weight and carbon contents of triolein (35114 kJ/mol; 885.4 g/mol; 57 mol C/mol) and glucose (28.3 kJ/mol; 180 g/mol; 6 mol C/mol), respectively. The carbon and energy contents of the starch-glucose equivalents were calculated as decribed above for the soluble sugar fraction. In summary, the formulas used to obtain carbon content and energy density of the different carbon metabolic pools are as follows:

Carbon content of TAG (mmol C/g leaf dry weight)=(% TAG×57 mol C/mol TAG×1000)/(100×885.4 g/mol TAG)

Carbon content of soluble sugars (mmol C/g leaf dry weight)=[(% total carbohydrates−(% starch× 180/162))×6 mol C/mol glucose*1000]/(100*180 g/mol glucose)

Carbon content of starch (mmol C/g leaf dry weight)=[(% starch×180/162))×6 mol C/mol glucose*1000]/(100*180 g/mol glucose)

Energy content of TAG (kJ/g leaf dry weight)=(% TAG×39.66 kJ/g TAG)/100

Energy content of soluble sugars (kJ/g leaf dry weight)=[(% total carbohydrates−(% starch× 180/162))×15.57 kJ/mol glucose]/100

Energy content of starch (kJ/g leaf dry weight)=[(% starch×180/162))×15.57 kJ/mol glucose]/100.

Example 2. Silencing of a TAG Lipase in Plants Accumulating High Levels of TAG in Leaf Tissue The Sugar Dependent 1 (SDP1) TAG lipase has been demonstrated to play a role in TAG turnover in non-seed tissues of *A. thaliana* as well as during seed germination (Eastmond et al., 2006; Kelly et al., 2011; Kelly et al., 2013). SDP1 is expressed in developing seed and the SDP1 polypeptide is also present in mature seed in association with oil bodies. Silencing of the gene encoding SDP1 resulted in a small but significant increase in TAG levels in *A. thaliana* roots and stems (<0.4% on dry weight basis) while an even smaller increase was observed in leaf tissue (Kelly et al., 2013).

To determine whether TAG levels could be increased further in leaf and stem tissues relative to co-expression of AtWRI1 and AtDGAT1, an experiment was designed to silence an endogenous SDP1 gene in *N. tabacum* plants which were homozygous for a T-DNA having genes for transgenic expression of the WRI, DGAT1 and Oleosin polypeptides (Vanhercke et al., 2014). A BLAST search of the *N. benthamiana* transcriptome (Naim et al., 2012) using the AtSDP1 nucleotide sequence as query identified a transcript (Nbv5tr6385200, SEQ ID NO:173) with homology to the *A. thaliana* SDP1 gene. A 713 bp region (SEQ ID NO:174) was selected for hairpin mediated gene silencing. A 3.903 kb synthetic fragment was designed, based on the pHELLSGATE12 vector, which comprised, in order, the enTCUP2 constitutive promoter, the 713 bp *N. benthamiana* SDP1 fragment in sense orientation flanked by attB1 and attB2 sites, a Pdk intron, a cat intron sequence in reverse orientation, a second 713 bp *N. benthamiana* SDP1 fragment flanked by attB1 and attB2 sites in reverse (antisense) orientation, and the OCS 3' region terminator/polyadenylation site (FIG. 2). The insert was subcloned into pJP3303 using SmaI and KasI restriction sites and the resulting expression vector was designated pOIL051. This chimeric DNA contains a hygromycin resistance selectable marker gene.

pOIL051 was used to produce transformed *N. tabacum* plants by *Agrobacterium*-mediated transformation. The starting plant cells were from transgenic plants which were homozygous for the T-DNA of pJP3502 (Vanhercke et al., 2014). Transgenic plants containing the T-DNA from pOIL051 were selected by hygromycin resistance and transferred to soil in the glasshouse or in a controlled environment cabinet for continued growth. Leaf samples were harvested from confirmed double-transformants (TO plants) before flowering, at flowering and at seed setting stages of plant development, and the TAG level in each determined. Transgenic plants containing only low levels of leaf TAG, or TAG at the same level as controls, were identified by means of lipid extraction from leaf samples and analysis by spot TLC and discarded. TAG levels in the remaining population of transformants were quantified by GC as described in Example 1. Before flowering, the majority of these plants exhibited greatly increased TAG levels (>5% of leaf dry weight) in their leaf tissue while 4 plants contained TAG levels above 10% (Table 3). The maximum TAG level observed in leaves of these plants, before flowering, was 11.3% in plant 51-13. As a comparison, the transgenic plants of the parental *N. tabacum* line expressing AtWRI1, AtDGAT1 and Oleosin displayed TAG levels of about 2% before flowering and about 6% during flowering (Vanhercke et al., 2014). The addition of the SDP1-inhibitory construct to the AtWRI1 plus AtDGAT1 combination was therefore synergistic for increasing the TAG levels in these plants. Surprisingly, the TAG content in leaves harvested from the doubly-transformed plants at flowering stage was greatly increased, observing 30.5% on a dry weight basis (Table 4), representing a 5-fold increase relative to the plants not silenced for SDP1. To the great amazement of the inventors, the TAG level reached an astonishing 70.7% (% of dry weight) in samples of senescing leaves (green and yellow) at the seed setting stage (Table 5). When NMR was used to measure the oil content of entire leaves from the tobacco plants at seed setting stage, the TAG content in some green leaves that had started senescing was about 43% and in some brown, desiccated leaves was 42%. When such leaves were pressed between two brown paper filters, the exuded oil soaked into the paper and made it translucent, whereas control tobacco leaves did not do so, providing a simple screening method for detecting plants having high oil content.

Two primary transformants (#61, #69) containing each of the T-DNAs from pJP3502 and pOIL51 and displaying high TAG levels were analyzed by digital PCR (ddPCR) using a hygromycin gene-specific primer pair to determine the number of pOIL51 T-DNA insertions. The plant designated #61 contained one T-DNA insertion from pOIL51, whereas plant

69 contained three T-DNA insertions from pOIL51. T1 progeny plants of both lines were screened again by ddPCR to identify homozygous, heterozygous and null plants. Progeny plants of plant #61 containing no insertions from pOIL51 (nulls; total of 7) or 2 T-DNA insertions (i.e. homozygous for that T-DNA; total of 12) were selected for further analysis. Similarly, progeny plants of line #69 containing zero T-DNA insertions from pOIL51 (nulls; total of 2) or 2 such insertions (total of 15) or 4 or 5 insertions (total of 5) were maintained for further analysis.

The selected T1 plants were grown in the glasshouse at the same time and under the same conditions as control plants. Green leaf tissue samples from the T1 plants before flowering were dried and total fatty acid (TFA) and TAG contents determined by GC analysis. TFA contents of the plants containing both T-DNAs ranged from 4.6% to 16.1% on a dry weight basis including TAG levels in the same leaves of 1.2% to 11.8% on a dry weight basis (FIG. 3). This was much greater compared to the plants containing only the T-DNA from pJP3502 and growing alongside under the same conditions and analysed at the same stage of growth, again showing the synergism between reducing TAG lipase activity and the WRI1 plus DGAT combination. Plants containing only the pJP3502 T-DNA contained between 4.2% and 6.8% TFA including TAG levels of 1.4% to 4.1% on a dry weight basis (FIG. 3). Wild-type plants contained, on average, about 0.8% TFA including less than 0.5% TAG on a dry weight basis. The fatty acid composition in the total fatty acid content and the TAG content of leaves from each of lines #61 and #69 were similar to the composition in leaves containing only the T-DNA from pJP3502 (parent). Compared to the wild-type control leaves, plants containing both of the T-DNAs from pOIL51 and pJP3502 exhibited increased levels of C16:0, C18:1 and C18:2 fatty acids. This significant shift in fatty acid composition came largely at the expense of C18:3 which was reduced from about 50-55% to about 20-30% as a percentage of the total fatty acid content.

TABLE 3

TAG levels (% leaf dry weight) and TAG fatty acid composition in leaf tissue from *N. tabacum* plants (T0 generation) expressing WRI1, DGAT1 and Oleosin transgenes and super-transformed with a T-DNA encoding an SDP1 hairpin construct (pOIL051), compared to wild-type (untransformed). Leaf samples were harvested during vegetative stage (before flowering). Lipid samples also contained 0.0-0.2% C16:3, 0.0-0.4% C20:1; 0.0-0.1% C20:2n-6.

| Line | C14:0 | C16:0 | C16:1 | C18:0 | C18:1 | C18:1d11 | C18:2 | C18:3n3 | C20:0 | C22:0 | C24:0 | % TAG |
|---|---|---|---|---|---|---|---|---|---|---|---|---|
| WT | 2.5 | 20.2 | 0.0 | 8.6 | 5.6 | 0.0 | 18.9 | 44.2 | 0.0 | 0.0 | 0.0 | 0.1 |
| 23-31 | 0.0 | 66.0 | 0.0 | 0.0 | 34.0 | 0.0 | 0.0 | 0.0 | 0.0 | 0.0 | 0.0 | 0.0 |
| 23-29 | 0.0 | 36.1 | 1.4 | 5.1 | 21.0 | 0.8 | 23.3 | 7.1 | 2.4 | 1.5 | 1.1 | 2.9 |
| 57 | 0.1 | 47.2 | 0.3 | 5.4 | 19.2 | 1.9 | 0.0 | 21.2 | 2.1 | 1.2 | 1.1 | 3.4 |
| 23-1 | 0.2 | 30.8 | 1.9 | 4.9 | 41.2 | 1.0 | 13.7 | 2.4 | 1.9 | 1.1 | 0.7 | 4.0 |
| 58 | 0.1 | 31.4 | 0.2 | 3.8 | 12.2 | 1.6 | 33.6 | 13.2 | 1.7 | 1.0 | 0.7 | 4.0 |
| 21 | 0.1 | 31.9 | 0.3 | 3.9 | 10.7 | 1.5 | 32.3 | 15.2 | 1.9 | 1.1 | 0.8 | 4.7 |
| 23-30 | 0.2 | 34.1 | 0.7 | 4.9 | 29.4 | 0.9 | 17.5 | 5.7 | 2.9 | 1.8 | 1.7 | 4.9 |
| 40 | 0.1 | 34.4 | 0.2 | 4.3 | 14.3 | 1.5 | 29.7 | 11.8 | 1.7 | 1.0 | 0.7 | 5.1 |
| 22 | 0.1 | 35.8 | 0.2 | 4.3 | 12.8 | 1.5 | 29.8 | 11.7 | 1.8 | 1.0 | 0.7 | 5.1 |
| 15 | 0.1 | 37.2 | 0.1 | 3.9 | 8.6 | 1.7 | 29.3 | 16.0 | 1.5 | 0.8 | 0.6 | 5.1 |
| 16 | 0.1 | 35.2 | 0.1 | 3.9 | 13.9 | 1.7 | 28.5 | 13.6 | 1.4 | 0.7 | 0.6 | 5.3 |
| 25 | 0.1 | 34.4 | 0.2 | 3.9 | 15.4 | 1.8 | 27.6 | 13.2 | 1.6 | 0.9 | 0.7 | 5.4 |
| 65 | 0.1 | 26.9 | 0.2 | 3.8 | 19.2 | 1.5 | 35.7 | 9.1 | 1.7 | 0.8 | 0.6 | 5.5 |
| 12 | 0.2 | 31.7 | 0.2 | 3.6 | 15.9 | 1.7 | 30.5 | 12.8 | 1.6 | 0.9 | 0.7 | 5.5 |
| 28 | 0.1 | 31.4 | 0.2 | 3.5 | 13.5 | 1.7 | 32.7 | 13.7 | 1.5 | 0.8 | 0.6 | 5.6 |
| 26 | 0.1 | 31.4 | 0.2 | 3.5 | 13.5 | 1.6 | 32.7 | 13.7 | 1.5 | 0.8 | 0.6 | 5.8 |
| 19 | 0.1 | 30.5 | 0.2 | 3.7 | 14.9 | 1.6 | 31.7 | 13.7 | 1.7 | 0.9 | 0.7 | 5.9 |
| 30 | 0.1 | 30.4 | 0.2 | 3.7 | 21.3 | 2.2 | 31.2 | 7.4 | 1.6 | 0.8 | 0.7 | 5.9 |
| 6 | 0.1 | 37.5 | 0.2 | 4.4 | 10.5 | 1.7 | 31.9 | 10.6 | 1.5 | 0.7 | 0.6 | 6.0 |
| 4 | 0.1 | 34.2 | 0.2 | 3.9 | 11.9 | 1.7 | 32.6 | 12.5 | 1.4 | 0.6 | 0.5 | 6.1 |
| 42 | 0.1 | 30.6 | 0.2 | 4.5 | 17.3 | 1.8 | 32.7 | 9.2 | 1.7 | 0.9 | 0.7 | 6.3 |
| 45 | 0.1 | 31.6 | 0.2 | 3.9 | 18.2 | 1.8 | 30.4 | 10.5 | 1.6 | 0.8 | 0.6 | 6.6 |
| 56 | 0.1 | 26.8 | 0.2 | 4.2 | 20.0 | 1.5 | 34.3 | 8.7 | 1.9 | 1.0 | 0.8 | 6.7 |
| 43 | 0.1 | 28.5 | 0.2 | 3.8 | 18.6 | 1.6 | 34.1 | 9.6 | 1.7 | 0.9 | 0.6 | 7.1 |
| 32 | 0.1 | 28.1 | 0.2 | 3.4 | 16.8 | 1.8 | 35.5 | 10.6 | 1.6 | 0.8 | 0.6 | 7.2 |
| 70 | 0.1 | 26.3 | 0.2 | 3.5 | 25.5 | 1.8 | 31.0 | 8.9 | 1.3 | 0.6 | 0.5 | 7.4 |
| 69 | 0.1 | 30.9 | 0.2 | 4.0 | 15.7 | 1.7 | 31.7 | 12.9 | 1.5 | 0.7 | 0.5 | 7.4 |
| 61 | 0.1 | 31.0 | 0.2 | 4.0 | 16.4 | 1.6 | 34.1 | 9.5 | 1.5 | 0.7 | 0.5 | 7.5 |
| 20 | 0.1 | 33.3 | 0.1 | 3.8 | 11.7 | 1.6 | 31.4 | 14.8 | 1.5 | 0.8 | 0.6 | 7.8 |
| 53 | 0.1 | 33.1 | 0.1 | 3.8 | 18.2 | 1.9 | 29.8 | 10.4 | 1.3 | 0.6 | 0.5 | 8.4 |
| 18 | 0.1 | 29.4 | 0.2 | 3.7 | 18.4 | 1.7 | 32.8 | 10.9 | 1.4 | 0.6 | 0.5 | 9.1 |
| 51-1 | 0.1 | 29.0 | 2.0 | 3.6 | 17.1 | 1.6 | 33.8 | 9.9 | 1.4 | 0.7 | 0.5 | 9.2 |
| 47 | 0.1 | 30.5 | 0.1 | 4.2 | 20.3 | 1.5 | 31.9 | 8.3 | 1.5 | 0.7 | 0.5 | 9.3 |
| 51-60 | 0.1 | 30.7 | 2.6 | 3.4 | 15.8 | 1.9 | 31.2 | 11.6 | 1.3 | 0.7 | 0.5 | 10.2 |
| 46 | 0.1 | 24.8 | 0.1 | 3.6 | 28.8 | 1.6 | 30.3 | 7.9 | 1.3 | 0.6 | 0.5 | 10.2 |
| 48 | 0.1 | 33.1 | 0.1 | 3.8 | 16.5 | 1.7 | 30.4 | 11.4 | 1.4 | 0.7 | 0.5 | 10.7 |
| 51-13 | 0.1 | 25.4 | 2.2 | 3.3 | 23.8 | 1.6 | 32.7 | 8.3 | 1.3 | 0.6 | 0.4 | 11.3 |

TABLE 4

TAG levels (% leaf dry weight) and TAG composition in leaf tissue from N. tabacum plants (T0 generation) expressing WRI1, DGAT1 and Oleosin transgenes and supertransformed with a T-DNA encoding an SDP1 hairpin construct (pOIL051). Leaf samples were harvested during flowering.

| Line | C14:0 | C16:0 | C16:1 | C18:0 | C18:1 | C18:1d11 | C18:2 | C18:3n3 | C20:0 | C22:0 | C24:0 | % TAG |
|---|---|---|---|---|---|---|---|---|---|---|---|---|
| WT | 0.2 | 14.8 | 0.6 | 8.5 | 9.2 | 0.3 | 20.0 | 44.5 | 0.6 | 0.3 | 0.4 | 0.3 |
| 21 | 0.1 | 25.7 | 2.1 | 3.7 | 21.2 | 1.0 | 31.0 | 11.7 | 1.5 | 0.8 | 0.6 | 8.8 |
| 56 | 0.1 | 33.2 | 1.4 | 4.9 | 20.7 | 1.0 | 26.3 | 7.4 | 2.1 | 1.3 | 0.9 | 9.2 |
| 65 | 0.1 | 24.7 | 1.5 | 3.8 | 28.5 | 1.0 | 29.0 | 7.5 | 1.7 | 0.9 | 0.6 | 12.0 |
| 42 | 0.1 | 34.0 | 1.5 | 4.4 | 16.8 | 1.1 | 29.4 | 7.6 | 2.2 | 1.4 | 1.1 | 13.1 |
| 28 | 0.1 | 29.5 | 2.4 | 3.5 | 16.4 | 1.2 | 28.7 | 14.6 | 1.5 | 1.0 | 0.6 | 13.2 |
| 30 | 0.1 | 19.1 | 1.9 | 3.3 | 31.8 | 1.0 | 30.6 | 9.3 | 1.3 | 0.7 | 0.4 | 13.6 |
| 20 | 0.1 | 22.4 | 1.8 | 3.7 | 27.4 | 0.9 | 29.0 | 10.8 | 1.7 | 0.9 | 0.7 | 14.6 |
| 19 | 0.1 | 20.9 | 1.7 | 3.1 | 28.4 | 1.0 | 31.6 | 10.0 | 1.4 | 0.8 | 0.5 | 15.7 |
| 12 | 0.1 | 24.4 | 1.6 | 3.6 | 22.1 | 0.9 | 35.1 | 8.9 | 1.4 | 0.8 | 0.5 | 15.8 |
| 16 | 0.1 | 21.5 | 1.8 | 3.4 | 34.9 | 1.0 | 26.2 | 7.9 | 1.4 | 0.7 | 0.5 | 16.4 |
| 57 | 0.1 | 25.0 | 1.7 | 4.1 | 27.7 | 1.0 | 28.4 | 8.4 | 1.6 | 0.9 | 0.6 | 17.2 |
| 26 | 0.1 | 22.5 | 1.6 | 3.5 | 28.4 | 1.1 | 31.2 | 7.6 | 1.7 | 1.0 | 0.7 | 18.0 |
| 39 | 0.1 | 30.0 | 2.2 | 3.7 | 22.7 | 1.6 | 24.3 | 11.6 | 1.5 | 0.9 | 0.7 | 18.1 |
| 70 | 0.1 | 22.1 | 2.1 | 3.6 | 36.3 | 1.0 | 24.2 | 7.2 | 1.4 | 0.7 | 0.5 | 18.3 |
| 45 | 0.1 | 21.4 | 1.8 | 3.7 | 34.4 | 1.0 | 27.5 | 6.9 | 1.4 | 0.8 | 0.5 | 19.1 |
| 32 | 0.1 | 23.3 | 1.6 | 3.2 | 24.4 | 1.1 | 33.6 | 9.0 | 1.5 | 0.9 | 0.6 | 19.5 |
| 18 | 0.1 | 23.4 | 2.1 | 3.3 | 26.4 | 0.9 | 30.2 | 10.3 | 1.4 | 0.7 | 0.5 | 20.6 |
| 20Y | 0.1 | 22.3 | 1.6 | 3.6 | 30.3 | 0.9 | 28.5 | 9.1 | 1.6 | 0.9 | 0.6 | 20.8 |
| 43 | 0.1 | 28.1 | 2.0 | 3.5 | 21.5 | 1.2 | 29.9 | 10.2 | 1.5 | 0.9 | 0.6 | 21.2 |
| 4 | 0.1 | 27.9 | 1.9 | 3.7 | 26.3 | 1.2 | 26.2 | 9.3 | 1.5 | 0.8 | 0.5 | 21.8 |
| 1 | 0.1 | 23.8 | 2.0 | 3.7 | 30.2 | 1.1 | 28.1 | 8.0 | 1.4 | 0.7 | 0.5 | 22.3 |
| 61 | 0.1 | 24.2 | 2.2 | 4.0 | 32.0 | 1.1 | 25.2 | 7.8 | 1.5 | 0.8 | 0.6 | 23.9 |
| 60 | 0.1 | 24.4 | 2.2 | 3.7 | 31.0 | 1.1 | 25.4 | 8.6 | 1.5 | 0.8 | 0.6 | 25.0 |
| 46 | 0.1 | 23.3 | 2.0 | 3.7 | 32.9 | 1.0 | 24.0 | 9.2 | 1.6 | 0.9 | 0.7 | 25.7 |
| 6 | 0.1 | 31.5 | 2.6 | 3.5 | 19.5 | 1.6 | 25.5 | 12.7 | 1.3 | 0.7 | 0.5 | 26.3 |
| 13 | 0.1 | 21.8 | 1.9 | 3.6 | 35.1 | 1.0 | 25.1 | 8.1 | 1.5 | 0.8 | 0.5 | 26.8 |
| 69 | 0.1 | 21.8 | 1.6 | 4.3 | 33.4 | 0.8 | 26.9 | 7.6 | 1.7 | 0.8 | 0.5 | 26.9 |
| 53 | 0.1 | 27.1 | 2.1 | 3.5 | 24.1 | 1.2 | 29.4 | 9.2 | 1.4 | 0.8 | 0.5 | 29.2 |
| 48 | 0.1 | 29.5 | 2.5 | 3.9 | 21.1 | 1.3 | 29.0 | 9.2 | 1.6 | 0.8 | 0.6 | 29.5 |
| 47 | 0.1 | 30.9 | 2.5 | 3.4 | 19.4 | 1.5 | 28.5 | 10.6 | 1.3 | 0.8 | 0.5 | 30.5 |

TABLE 5

TAG content (% leaf dry weight) and TAG composition in leaf tissue from N. tabacum plants (T0 generation) expressing WRI1, DGAT1 and Oleosin transgenes and supertransformed with a T-DNA encoding an SDP1 hairpin construct (pOIL051). Leaf samples were harvested at seed setting stage. Y = yellow leaf, G = green leaf.

| Sample | C14:0 | C16:0 | C16:1 | 16:3 | C18:0 | C18:1 | C18:1d11 | C18:2 | C18:3n3 | C20:0 | C20:1d11 | C22:0 | C24:0 | TAG content |
|---|---|---|---|---|---|---|---|---|---|---|---|---|---|---|
| wt | 0.0 | 13.0 | 0.0 | 0.0 | 8.4 | 7.0 | 0.0 | 24.7 | 46.6 | 0.0 | 0.0 | 0.0 | 0.0 | 0.3 |
| 73 | 0.0 | 26.6 | 1.7 | 0.0 | 8.5 | 9.4 | 0.0 | 27.0 | 25.6 | 1.1 | 0.0 | 0.0 | 0.0 | 0.6 |
| 18 | 0.1 | 15.0 | 1.8 | 0.0 | 4.8 | 14.4 | 0.4 | 43.9 | 16.3 | 1.7 | 0.4 | 0.7 | 0.5 | 3.3 |
| 41 | 0.1 | 22.3 | 1.2 | 0.3 | 4.4 | 24.0 | 0.6 | 32.8 | 10.8 | 1.7 | 0.3 | 0.8 | 0.5 | 5.2 |
| 19 | 0.1 | 14.5 | 1.5 | 0.3 | 3.0 | 21.6 | 0.7 | 44.8 | 10.6 | 1.4 | 0.4 | 0.7 | 0.4 | 7.2 |
| 20 | 0.1 | 26.7 | 2.4 | 0.1 | 4.3 | 24.9 | 1.0 | 25.2 | 11.3 | 1.9 | 0.3 | 1.0 | 0.8 | 9.6 |
| 30 | 0.1 | 18.6 | 1.5 | 0.3 | 3.5 | 24.8 | 0.7 | 38.9 | 8.9 | 1.4 | 0.3 | 0.7 | 0.4 | 9.9 |
| 65 | 0.1 | 22.2 | 1.4 | 0.3 | 3.5 | 30.9 | 0.7 | 29.1 | 8.1 | 1.7 | 0.3 | 1.0 | 0.6 | 11.3 |
| 42 | 0.1 | 23.6 | 1.5 | 0.2 | 4.1 | 29.0 | 0.9 | 30.3 | 5.9 | 2.0 | 0.4 | 1.3 | 0.8 | 12.0 |
| 32 | 0.1 | 21.3 | 1.3 | 0.3 | 3.3 | 21.4 | 0.9 | 40.7 | 7.1 | 1.7 | 0.3 | 1.0 | 0.6 | 13.7 |
| 39 | 0.1 | 25.8 | 1.7 | 0.3 | 3.6 | 27.2 | 1.2 | 27.2 | 8.2 | 2.0 | 0.4 | 1.4 | 0.9 | 14.0 |
| 45 | 0.1 | 23.0 | 1.5 | 0.1 | 3.8 | 28.0 | 0.9 | 32.6 | 6.3 | 1.8 | 0.3 | 1.0 | 0.6 | 14.4 |
| 13 | 0.1 | 26.9 | 2.8 | 0.1 | 3.7 | 32.6 | 1.1 | 21.6 | 7.6 | 1.6 | 0.3 | 0.8 | 0.7 | 14.6 |
| R45 | 0.1 | 23.4 | 1.5 | 0.2 | 4.1 | 27.8 | 0.9 | 32.2 | 6.1 | 1.8 | 0.3 | 1.0 | 0.6 | 14.6 |
| 21 | 0.1 | 23.1 | 1.6 | 0.2 | 3.5 | 27.4 | 0.8 | 31.2 | 8.2 | 1.8 | 0.3 | 1.1 | 0.7 | 15.0 |
| 9 | 0.1 | 23.2 | 1.4 | 0.2 | 3.5 | 23.3 | 0.8 | 35.6 | 8.5 | 1.6 | 0.3 | 0.9 | 0.5 | 15.4 |
| 12 | 0.1 | 24.5 | 1.4 | 0.2 | 3.4 | 22.3 | 0.8 | 36.2 | 7.4 | 1.7 | 0.3 | 1.1 | 0.7 | 15.9 |
| 4 | 0.1 | 21.9 | 1.8 | 0.2 | 3.6 | 22.8 | 0.9 | 35.9 | 9.5 | 1.6 | 0.3 | 0.9 | 0.6 | 16.1 |
| 49 | 0.1 | 23.5 | 1.4 | 0.2 | 4.0 | 25.3 | 0.8 | 34.3 | 6.6 | 1.8 | 0.3 | 1.1 | 0.7 | 16.8 |
| 26 | 0.1 | 22.2 | 1.3 | 0.2 | 3.8 | 25.4 | 0.8 | 35.2 | 6.5 | 2.1 | 0.3 | 1.3 | 0.8 | 17.2 |
| 16 | 0.1 | 22.2 | 1.8 | 0.3 | 3.4 | 29.9 | 0.8 | 30.1 | 8.1 | 1.5 | 0.3 | 0.9 | 0.6 | 18.2 |
| 1 | 0.1 | 27.4 | 2.7 | 0.1 | 4.0 | 32.0 | 1.2 | 22.9 | 6.3 | 1.6 | 0.3 | 0.8 | 0.7 | 18.7 |
| 70 | 0.1 | 27.1 | 2.7 | 0.2 | 3.7 | 32.6 | 1.0 | 21.5 | 7.6 | 1.6 | 0.3 | 0.8 | 0.7 | 19.0 |
| 6 | 0.1 | 30.6 | 2.6 | 0.2 | 3.3 | 13.0 | 1.4 | 32.8 | 12.9 | 1.4 | 0.2 | 0.9 | 0.6 | 21.5 |
| 47 | 0.1 | 28.0 | 2.1 | 0.2 | 3.6 | 18.5 | 1.3 | 33.2 | 9.9 | 1.5 | 0.2 | 0.9 | 0.5 | 21.6 |
| 69 | 0.1 | 25.4 | 2.3 | 0.1 | 4.3 | 32.4 | 0.9 | 23.5 | 7.4 | 1.8 | 0.3 | 0.8 | 0.6 | 22.5 |
| 53 | 0.1 | 23.9 | 2.1 | 0.2 | 3.4 | 28.2 | 1.1 | 30.2 | 7.6 | 1.5 | 0.3 | 0.9 | 0.5 | 23.2 |

TABLE 5-continued

TAG content (% leaf dry weight) and TAG composition in leaf tissue from *N. tabacum* plants (T0 generation) expressing WRI1, DGAT1 and Oleosin transgenes and supertransformed with a T-DNA encoding an SDP1 hairpin construct (pOIL051). Leaf samples were harvested at seed setting stage. Y = yellow leaf, G = green leaf.

| Sample | C14:0 | C16:0 | C16:1 | 16:3 | C18:0 | C18:1 | C18:1d11 | C18:2 | C18:3n3 | C20:0 | C20:1d11 | C22:0 | C24:0 | TAG content |
|---|---|---|---|---|---|---|---|---|---|---|---|---|---|---|
| 46   | 0.1 | 25.9 | 2.7 | 0.2 | 3.7 | 32.0 | 1.1 | 22.8 | 8.2  | 1.6 | 0.3 | 0.8 | 0.7 | 24.0 |
| 43   | 0.1 | 23.7 | 1.6 | 0.2 | 3.1 | 22.6 | 0.9 | 37.6 | 7.4  | 1.4 | 0.2 | 0.8 | 0.5 | 24.0 |
| 48   | 0.1 | 27.4 | 2.2 | 0.1 | 4.1 | 23.0 | 1.1 | 31.3 | 6.9  | 1.9 | 0.3 | 1.0 | 0.7 | 24.4 |
| 28   | 0.1 | 23.0 | 1.4 | 0.2 | 3.3 | 24.8 | 1.0 | 35.6 | 7.3  | 1.6 | 0.3 | 0.9 | 0.6 | 26.6 |
| 1Y   | 0.1 | 24.3 | 2.5 | 0.1 | 3.8 | 35.7 | 1.1 | 22.6 | 6.7  | 1.6 | 0.3 | 0.7 | 0.6 | 28.1 |
| 56G  | 0.1 | 25.5 | 1.8 | 0.2 | 3.7 | 26.7 | 0.9 | 29.8 | 7.3  | 1.8 | 0.3 | 1.1 | 0.7 | 33.9 |
| 57   | 0.1 | 25.1 | 1.9 | 0.2 | 3.2 | 20.1 | 1.0 | 35.2 | 10.0 | 1.5 | 0.3 | 0.9 | 0.6 | 35.4 |
| 56Y  | 0.2 | 24.8 | 1.4 | 0.2 | 4.1 | 27.2 | 0.8 | 31.0 | 6.0  | 2.0 | 0.4 | 1.2 | 0.8 | 39.6 |
| 69Y  | 0.1 | 24.7 | 2.1 | 0.2 | 4.1 | 32.0 | 0.8 | 24.3 | 7.8  | 1.9 | 0.3 | 0.9 | 0.7 | 46.5 |
| R69Y | 0.1 | 24.7 | 2.1 | 0.2 | 4.1 | 32.0 | 0.8 | 24.4 | 7.9  | 1.9 | 0.3 | 0.9 | 0.7 | 46.8 |
| 61   | 0.1 | 26.6 | 2.7 | 0.1 | 3.6 | 31.6 | 1.1 | 23.8 | 7.4  | 1.4 | 0.3 | 0.7 | 0.5 | 49.2 |
| 61Y  | 0.1 | 25.8 | 2.4 | 0.1 | 3.7 | 32.4 | 1.1 | 24.3 | 6.9  | 1.5 | 0.3 | 0.7 | 0.5 | 58.1 |
| 60   | 0.1 | 24.6 | 2.4 | 0.2 | 3.6 | 34.1 | 1.0 | 24.4 | 6.4  | 1.5 | 0.3 | 0.7 | 0.5 | 70.7 |

The substantial increase in TFA levels including the TAG levels between the plants containing only the pJP3502 T-DNA and plants containing the T-DNAs from both pOIL51 and pJP3502 was maintained throughout plant development. Control plants containing only the T-DNA from pJP3502 contained 7.7% to 17.5% TAG during flowering while TAG levels ranged from 14.1% to 20.7% on a dry weight basis during seed setting. The TAG content in leaves from plants containing both pJP3502 and pOIL51 T-DNAs varied between 6.3% and 23.3% during flowering and 12.6% and 33.6% during seed setting. Similar changes in fatty acid composition of the TAG fraction at both stages were detected as described earlier for the vegetative growth stage.

TAG levels were also found to be increased further in other vegetative tissues of the transgenic plants such as roots and stem. Some root tissues of the transgenic *N. tabacum* plants transformed with the T-DNA of pOIL051 contained 4.4% TAG, and some stem tissues 7.4% TAG, on a dry weight basis (FIG. 4). Wild-type plants and *N. tabacum* containing only the T-DNA from pJP3502 exhibited much lower TAG levels in both tissues. The addition of the hairpin SDP1 construct to decrease expression of the endogenous TAG lipase was clearly synergistic with the genes encoding the transcription factor and biosynthesis of TAG (WRI1 and DGAT) for increasing TAG content in the stems and roots. Of note, TAG levels in the roots were lower compared to stem tissue within the same plant while an inverse trend was observed in wild-type plants and *N. tabacum* containing only the T-DNA from pJP3502. The TAG composition of root and stem tissues exhibited similar changes in C18:1 and C18:3 fatty acids as observed previously in transgenic leaf tissue. C18:2 levels in TAG were reduced in transgenic stem tissue while C16 fatty acids were typically reduced in transgenic root tissues when compared to the wild-type control.

Therefore, the inventors concluded that addition of an exogenous gene for silencing the endogenous SDP1 gene to the combination of WRI1 and DGAT increased the total fatty acid content, including the TAG content, at all stages of the plant growth, and acted synergistically with WRI1 and DGAT, particularly in the stems and roots.

T1 seeds from the transgenic plants were plated on tissue culture media in vitro at room temperature to test the extent and timing of germination. Germination of T1 seed from three independently transformed lines was the same compared to seed from the transgenic plants transformed only with the T-DNA from pJP3502. Furthermore, early seedling vigour appeared to be unaffected. This was surprising given the role of SDP1 in germination in *A. thaliana* seeds and the observed defects in germination in SDP1 mutants (Eastmond et al., 2006). To overcome any germination defects if such had occurred, a second construct is designed in which the SDP1 inhibitory RNA is expressed from a promoter which is essentially not expressed, or at low levels, in seed, such as for example a promoter from a photosynthetic gene such as SSU. The inventors consider that it is beneficial to reduce the risk of deleterious effects on seed germination or early seedling vigour to avoid a constitutive promoter, or at least to avoid a promoter expressed in seeds, to drive expression of the SDP1 inhibitory RNA.

It was noted that the T0 plants with the highest TAG levels had been grown under high light conditions in the controlled environment room (500 micro moles light intensity, 16 hr light/26° C.-8 hr dark/18° C. day cycle) and appeared smaller (about 70% in height relative to the plants transformed with the T-DNA from pJP3502) than the wild-type control plants. The inventors concluded that the combination of transgenes and/or genetic modifications for the "push", "pull", "protect" and "package" approaches was particularly favourable for achieving high levels of TAG in vegetative plant parts. In this example, WRI1 provided the "push", DGAT provided the "pull", silencing of SDP1 provided the "protect" and Oleosin provided the "packaging" of TAG.

Example 3. Senescence-Specific Expression of a Transcription Factor

Ectopic expression of master regulators of embryo and seed development such as LEC2 have been reported to increase TAG levels in non-seed tissues (Santos-Mendoza et al., 2005; Slocombe et al., 2009; Andrianov et al., 2010). However, constitutive over-expression of LEC2 in plants transformed with a 35S-LEC2 gene resulted in unwanted pleiotropic effects on plant development and morphology including somatic embryogenesis and abnormal leaf structures (Stone et al., 2001; Santos-Mendoza et al., 2005). To test whether limiting LEC2 expression to the leaf senescence stage of plant development, i.e. after plants had fully grown and reached their full biomass, would minimize undesirable phenotypic effects but still increase leaf lipid levels, a chimeric DNA was designed and made for expression of LEC2 under the control of a *A. thaliana* senescence specific promoter from the SAG12 gene (U37336; Gan and Amasino, 1995).

To make the genetic construct, a 3.635 kb synthetic DNA fragment was made comprising, in order, an *A. thaliana* SAG12 senescence-specific promoter, the LEC2 protein coding sequence and a *Glycine max* Lectin gene terminator/ polyadenylation region. This fragment was inserted between the SacI and NotI restriction sites of pJP3303. This construct was designated pOIL049 and tested in leaves of *N. tabacum* plants which were stably transformed with genes encoding WRI1, DGAT1 and Oleosin polypeptides, containing the T-DNA from pJP3502. Using *Agrobacterium*-mediated transformation methods, the pOIL049 construct was used to transform *N. tabacum* plant cells which were homozygous for the T-DNA of pJP3502. Transgenic plants comprising the genes from pOIL049 were selected by hygromycin resistance and were grown to maturity in the glasshouse. Samples are taken from transgenic leaf tissue at different stages of growth including at leaf senescence and contain increased TAG levels compared to the *N. tabacum* pJP3502 parent line.

A total of 149 independent T0 plants (i.e. primary transformants) were obtained. Upper green leaves of all plants and the lower brown, fully senesced leaves of selected events were sampled at the seed setting stage of plant development and TAG contents were quantified by TLC-GC. The number of pOIL49 T-DNA insertions in selected plants was determined by ddPCR using a hygromycin gene-specific primer pair. A TAG level of 30.2% on a dry weight basis was observed in green leaf tissue harvested at seed setting stage. TAG levels in brown leaves were lower in most of the plants sampled. However, three plants (#32b, #8b and #23c) displayed greater TAG levels in brown senesced leaf tissue than in the green expanding leaves. These plants contained 1, 2 or 3 T-DNA insertions from pOIL49.

T1 progeny of plants #23c and #32b were screened by ddPCR to identify nulls, heterozygous and homozygous plants for the T-DNA from pOIL049. Progeny plants of plant #23c containing zero T-DNA insertions from pOIL049 (nulls; total of 7) or two T-DNA insertions of the T-DNA from pOIL049 (homozygous; total of 4) were selected for further analysis. Similarly, progeny plants of plant #32b containing zero insertions (nulls; total of 6) or two insertions (homozygous; total of 9) were maintained for further analysis. Green leaf tissue was sampled before flowering and TFA and TAG contents were determined by GC. Wild-type plants and plants transformed with the T-DNA from pJP3502 were the same as before (Example 2) and were grown alongside in the same glasshouse. TFA levels in leaves of the transformants containing the T-DNA from pOIL049 ranged from 5.2% to 19.5% on a dry weight basis before flowering (FIG. 5). TAG levels in the same tissues ranged from 0.8% to 15.4% on a dry weight basis. This was considerably greater than in plants containing only the T-DNA from pJP3502. TAG levels in plants containing the T-DNAs from pJP3502 and pOIL049 further increased to 38.5% and 34.9% during flowering and seed setting, respectively. When the fatty acid composition of the total fatty acid content was analysed for leaves homozygous for the T-DNA from pOIL049, increased levels of C18:2 and reduced levels of C18:3 were observed (FIG. 5) while the percentages of C16:0 and C18:1 remained about the same relative to leaves transformed only with the T-DNA from pJP3502. These data demonstrated that the addition of a second transcription factor gene under the control of a non-constitutive promoter to provide developmentally-regulated expression was able to further increase TAG levels in vegetative tissues of a plant. The data also indicated that the senescence-specific promoter SAG12 had some expression in the green tissue prior to senescence of the leaves.

TAG levels were much increased in stem tissue when compared to both wild-type *N. tabacum* plants and transgenic plants containing the T-DNA from pJP3502 alone. Some stem tissues of the transgenic *N. tabacum* plants transformed with the T-DNA from pOIL049 contained 4.9% TAG on a dry weight basis (FIG. 6). On the other hand, TAG levels in root tissue exhibited large variation between the three pOIL049 plants with some root tissues containing 3.4% TAG. Of note, TAG levels in roots were lower compared to stem tissue within the same plant while an inverse trend was observed in wild-type plants and *N. tabacum* containing only the T-DNA from pJP3502. The TAG composition of root and stem tissues exhibited similar changes in C18:1 and C18:3 fatty acids as observed previously in transgenic leaf tissue. C18:2 levels in TAG were reduced in transgenic stem tissue while C16 fatty acids were typically reduced in transgenic root tissues when compared to the wild-type control.

Corresponding genetic constructs are made encoding other transcription factors under the control of the SAG12 promoter, namely LEC1, LEC1 like, FUS3, ABI3, ABI4 and ABI5 and others (see Example 9). For example, additional constructs were made for the expression of the monocot transcription factor *Zea mays* LEC1 (Shen et al., 2010) or *Sorghum bicolor* LEC1 (Genbank Accession No. XM_002452582.1) under the control of monocot-derived homolog of the *A. thaliana* SAG12 promoter such as the maize SEE1 promoter (Robson et al., 2004). Further constructs are made for expression of the transcription factors under developmentally controlled promoters, for example which are preferentially expressed at flowering (e.g. day length sensitive promoters), Phytochrome promoters, Chryptochrome promoters, or in plant stems during secondary growth such as a promoter from a CesA gene. These constructs are used to transform plants, and plants which produce at least 8% TAG in vegetative parts are selected.

Example 4. Analysis of Transgenic Plants

Plant Material and Growth Conditions

Plants of three TAG accumulating transgenic lines were grown in growth cabinets or in a glasshouse under controlled conditions:

1. Plants over-expressing genes encoding WRI1, DGAT and oleosin (Vanhercke et al, 2014), designated here as HO plants, being plants of the T2 generation which were homozygous for the introduced T-DNA from pJP3052.
2. T1 plants transformed with an RNAi construct to silence the SDP1 TAG lipase as well as the T-DNA from pJP3502, encoding the WRI1, DGAT and oleosin polypeptides, from two independent transformed lines. See Example 2. These plants were designated SDP1.
3. T1 plants transformed with a genetic construct for over-expressing the transcription factor LEC2 from the SAG12 promoter, as well as the T-DNA from pJP3502 encoding the WRI1, DGAT and oleosin polypeptides. See Example 3. These plants were designated LEC2, and were progeny from a single T0 plant.

Wild-type plants (WT, of cultivar Wisconsin 38) were used as control plants and grown at the same time and under the same conditions as the transgenic plants. For vegetative samples, WT and HO tobacco plants were grown in PGC20/PGC20FLEX plant growth cabinets (Conviron) at ambient $CO_2$ concentrations with 250-450 µmol m$^{-2}$ s$^{-1}$ illumination from fluorescent bulbs. Plants were grown under 12 hr light/25° C.: 12 hr dark/20° C. daily cycles. Plants from which samples were to be harvested at 49 days after sowing (DAS) were grown in 1.25 litre pots in soil with osmocote fertiliser. Plants from which samples were to be harvested at 69 DAS were grown in 4 litre pots in soil and watered every 14 days with aquasol fertiliser. For all assays, samples were taken from four plants of each genotype. For samples to be harvested at seed-setting stage of growth, WT, HO, SDP1 and LEC2 plants were grown in a glasshouse without artificial light (n=3, 3, 8, 6, respectively). For all analyses, leaf discs were harvested from leaves at the end of the growth phase with light, snap frozen and stored at –80° C. until analysis.

TAG Levels and Fatty Acid Composition

TAG levels were measured in leaves of mature WT, HO, SDP1 and LEC2 plants. The fatty acid composition in TAG of the leaves was also determined. The data are shown in Table 6 for the LEC2 and SDP1 plants.

by increasing the TAG content more than compensated for the reduced starch content. Therefore, the transgenic plants exhibited increased total carbon content and increased total energy content on a dry weight basis.

Nitrogen and Soluble Protein Contents

Nitrogen and protein contents were measured in leaf samples of the transformed and control plants as described in Example 1, for plants at 69 DAS. The third leaf from the top of each of the WT and HO tobacco plants, which leaves were not yet fully expanded and therefore still growing, had the same nitrogen content at about 3.0% by DW. Older (lower) leaves on each plant were also analysed. In the WT plants, the leaf nitrogen content decreased with leaf age, whereas the nitrogen content was relatively maintained in older HO leaves with less of a decline compared to the WT plants. For example, older leaves such as leaf 11 from the top of the HO plants had more than twice as much nitrogen (2.9%) compared to the corresponding leaves in WT plants (1.3%; FIG. 9a). A similar trend was observed for total soluble protein with twice as much soluble protein detected in older HO leaves compared to WT (10.4 and 5.0 µg/mg FW, respectively; FIG. 9B). The same trends were observed when soluble protein samples were electrophoresed by SDS-PAGE, after normalising sample loading according to leaf fresh weights.

TABLE 6

TAG levels (% leaf dry weight) and fatty acid composition in TAG of selected *N. tabacum* primary transformants over-expressing LEC2 (pOIL049) or a silencing construct targeted against the gene encoding SDP1 TAG lipase (pOIL051). Both constructs were transformed independently into a previously established *N. tabacum* transgenic line over-expressing genes encoding WRI1, DGAT1 and OLEOSIN (Vanhercke et al., 2014).

| Transgene | Line | Leaf | C16:0 | C16:1 | C18:0 | C18:1$^{\Delta 9}$ | C18:2$^{\Delta 9,12}$ | C18:3$^{\Delta 9,12,15}$ | Other | % TAG |
|---|---|---|---|---|---|---|---|---|---|---|
| LEC2 | #8 | green | 28.3 | 3.1 | 3.2 | 19.8 | 30.5 | 10.2 | 5.0 | 8.3 |
|  | #8 | brown | 31.1 | 2.4 | 3.7 | 16.5 | 32.4 | 7.7 | 6.2 | 12.6 |
| LEC2 | #23 | green | 26.6 | 5.5 | 0.1 | 5.4 | 48.0 | 7.3 | 7.2 | 14.3 |
|  | #23 | brown | 26.2 | 5.2 | 2.5 | 3.5 | 47.0 | 8.1 | 7.5 | 28.7 |
| LEC2 | #32 | green | 28.0 | 1.0 | 4.3 | 19.7 | 29.2 | 10.9 | 6.7 | 5.8 |
|  | #32 | brown | 22.3 | 3.1 | 2.4 | 19.7 | 39.0 | 7.2 | 6.3 | 14.0 |
| SDP1 | #60 | brown | 28.0 | 3.8 | 3.1 | 35.9 | 19.7 | 5.8 | 3.6 | 26.4 |
| SDP1 | #61 | brown | 27.7 | 3.7 | 3.4 | 34.0 | 20.7 | 6.5 | 4.0 | 27.9 |
| SDP1 | #69 | yellow-green | 28.1 | 3.4 | 3.6 | 29.5 | 23.3 | 8.1 | 3.9 | 32.9 |

Starch and Sugar Levels

Starch and soluble sugar levels were measured in leaf tissue sampled from the wild-type (WT) and transgenic HO, SDP1 and LEC2 plants. In general, an inverse correlation was found between TAG and starch levels in leaf tissue on a dry weight basis in the leaves having both T-DNAs (FIG. 7 and FIG. 8). In contrast, leaf soluble sugars levels were about the same in the transgenic plants as in the wild-type plants, suggesting that there was no significant bottleneck in the conversion from sugars to TAG. An effect of the leaf position in the plants was observed in wild-type plants where starch levels tended to increase from lower leaf to higher leaf position. No such effect was detected in the transgenic plants.

Carbon and Energy Contents

The amounts of carbon and energy in the TAG, starch and sugar contents in leaves of the HO, SDP1 and LEC2 plants were measured and compared to wild-type plants, on a dry weight basis. The data (Table 7) showed that each of the carbon and energy contents increased in the HO plants and increased even further in the SDP1 and LEC2 plants relative to the WT plants. The increase was seen for the sum of TAG, starch and soluble sugars, as well as for the sum of TAG and starch. It was concluded that the increase in carbon content

TABLE 7

Carbon and energy contents of TAG, starch and soluble sugars in leaf tissues of wild-type and transgenic *N. tabacum* plants.

| | Carbon (mmol C/gDW) | | | Energy (kJ/g DW)* | | |
|---|---|---|---|---|---|---|
| | TAG | Starch | Soluble sugars | TAG | Starch | Soluble sugars |
| wt1 | 0.08 | 15.41 | 1.33 | 0.05 | 7.20 | 0.62 |
| wt6 | 0.08 | 12.01 | 1.29 | 0.05 | 5.61 | 0.60 |
| wt7 | 0.09 | 11.10 | 1.37 | 0.06 | 5.18 | 0.64 |
| HO #2 | 10.69 | 5.43 | 1.24 | 6.59 | 2.54 | 0.58 |
| HO #5 | 8.63 | 10.78 | 1.86 | 5.32 | 5.04 | 0.87 |
| HO #7 | 9.51 | 8.22 | 1.47 | 5.86 | 3.84 | 0.69 |
| SDP1 #69-1 | 19.56 | 2.83 | 1.61 | 12.05 | 1.32 | 0.75 |
| SDP1 #69-60 | 21.44 | 3.11 | 2.03 | 13.21 | 1.45 | 0.95 |
| SDP1 #69-91 | 16.78 | 0.68 | 1.71 | 10.33 | 0.32 | 0.80 |
| LEC2 #32-21 | 14.99 | 0.57 | 0.88 | 9.23 | 0.27 | 0.41 |
| LEC2 #32-29 | 19.19 | 0.86 | 0.82 | 11.82 | 0.40 | 0.39 |

*assuming 2803 kJ/mol for glucose and 35114 kJ/mol for triolein (Sanjaya et al., 2011)

In both WT and HO plants, leaf protein content increased with plant age (FIG. 10, Table 8). In younger plants (49 DAS), soluble protein content was slightly but not significantly higher in older leaves from HO plants compared to WT. By 69 DAS, this difference was significant with an 87% increase in old HO leaves compared to WT (p<0.05, t-test). It was concluded that the leaves of the HO plants had significantly increased nitrogen and protein contents relative to the corresponding leaves in the WT plants. In this context, a "corresponding leaf" meant a leaf of the same age of a plant grown under the same conditions.

TABLE 8

Leaf soluble protein content in WT and HO tobacco (μg/mg FW). Range includes young, mature and older leaves of younger (49 DAS) and older (69 DAS) plants.

|  | WT | | HO | |
|---|---|---|---|---|
| Plant age | 49 DAS | 69 DAS | 49 DAS | 69 DAS |
| Range | 4.3-9.9 | 3.0-15.2 | 2.5-11.3 | 7.9-19.1 |

Nitrogen Content in SDP1 and LEC2 Plants

The transgenic plants designated LEC2 and SDP1 exhibited increased TAG accumulation compared to the HO plants throughout growth (Examples 2 and 3), increasing with plant age. Leaf samples of the transgenic plants grown in growth cabinets or in the glasshouse were assayed for nitrogen, protein and carbon contents. The LEC2 and SDP1 plants exhibited each of increased leaf carbon content, leaf nitrogen content and soluble protein content relative to the WT plants (Table 9). At the seed setting stage of growth, the LEC2 and SDP1 leaves had between 50% and 100% more nitrogen than WT leaves. The leaf soluble protein content increased between 40% and 87% in LEC2 and SDP1 leaves, respectively, relative to the WT leaves. Leaf carbon content also increased. Despite moderate increases in leaf carbon content (16% to 21%) in LEC2 and SDP1 lines, the greater relative increase in leaf nitrogen content decreased the carbon to nitrogen ratio by up to 40% compared to WT leaves.

Total Dietary Fibre (TDF)

Analysis of the total dietary fibre of WT, SDP1 and LEC2 in mature leaves obtained at flowering showed that WT leaves had a TDF content of 27%, SDP1 leaves had a TDF content of 15.9% (59% reduction when compared to WT), and LEC2 leaves had a TDF content of 17.9% (34% reduction when compared to WT).

TABLE 9

TAG content (% dry weight), carbon content, nitrogen content and soluble protein content of WT, LEC2 and SDP1 tobacco leaves. For TAG analysis n = 3-8 and for C, N and soluble protein n = 2-5.

|  | TAG content | Nitrogen content | Carbon content | C:N ratio | Soluble protein content |
|---|---|---|---|---|---|
| WT | 0.17 | 0.50 | 43.08 | 86:1 | 1.47 |
| LEC2 | 24.57 | 0.85 | 52.08 | 51:1 | 2.06 |
| SDP1 | 28.52 | 1.07 | 49.92 | 60:1 | 2.75 |

Upregulation of Genes Involved in Photosynthesis

The observations described above on the increase in carbon and energy contents in the transgenic plants led the inventors to consider whether the plants might exhibit an increase in photosynthetic capacity, related to the altered carbon allocation between starch and TAG. Therefore, the transcriptome of the HO plants was determined and compared to the transcriptome from WT plants grown under the same conditions. RNA was isolated from plants at the flowering stage, converted to cDNA and the full transcriptomes were determined. When the resultant sequence libraries were compared for the frequency of representation of individual genes, numerous genes involved in photosynthesis were observed to be up-regulated (over-expressed) in the HO plants. Table 10 lists representative genes which were up-regulated. From this, it was concluded that the capacity for photosynthesis was increased in the transgenic plants.

Effects of Modifying Photoperiod and Light Intensity

The growth conditions were modified compared to those described above, in order to test the effect of increasing or decreasing the photoperiod from the 12 hrs, and of increasing light intensity. In one growth chamber using high light intensity and long photoperiod, the $CO_2$ concentration was also increased above the ambient. The following conditions were tested, in each case plants were grown in PGC20/PGC20FLEX plant growth cabinets (Conviron) at 25° C. during the light period, 20° C. during the dark period and leaf samples were harvested at seed-setting stage of growth from leaf Nos. 9, 15 and 20 counting from the bottom of each plant. Leaf 9 was therefore the oldest of the sampled leaves, leaf 15 intermediate, and leaf 20 the youngest leaf sampled. Leafs were assayed for total fatty acid (TFA) content as described in Example 1.

TABLE 10

Listing of genes related to photosynthesis and whose expression was up-regulated.

| Unigene | log2FC | logCPM | LR | PValue | Arabidopsis Annotation | Nicotiana Annotation |
|---|---|---|---|---|---|---|
| c72304_g2_i2 | 1.03 | 6.31 | 14.04 | 0.000179411 | PSBP-2 photosystem II subunit P-2 chr2: 13118937-13120090 | PREDICTED: Oxygen-evolving enhancer protein 2-1, chloroplastic (LOC104217148) |
| c63827_g1_i2 | 2.31 | 0.95 | 21.08 | 4.40E−06 | NA | PREDICTED: PsbQ-like protein 1, chloroplastic (LOC104213138) variant X1 |
| c72304_g2_i6 | 1.19 | 2.43 | 15.20 | 9.66E−05 | PSBP-1, OEE2, PSII-P, OE23 photosystem II subunit P-1 chr1: 2047825-2049418 | PREDICTED: Oxygen-evolving enhancer protein 2-2, chloroplastic (LOC104220111) |
| c72995_g1_i1 | 3.02 | 3.42 | 101.49 | 7.18E−24 | NA | PREDICTED: Ferredoxin, root R-B1-like (LOC104250181), transcript variant X2 |
| c66865_g1_i2_1 | 1.30 | 2.69 | 12.05 | 0.000518939 | NA | PREDICTED: Photosystem II repair protein PSB27-H1, chloroplastic (LOC104235950) |
| c64448_g1_i1_1 | 1.06 | 8.91 | 13.35 | 0.000258132 | NA | PREDICTED: Ferredoxin (LOC104243179), mRNA |
| c65326_g1_i1 | 1.17 | 8.45 | 20.85 | 4.97E−06 | NA | PREDICTED: Oxygen-evolving enhancer protein 3-2, (LOC104238927) |

TABLE 10-continued

Listing of genes related to photosynthesis and whose expression was up-regulated.

| Unigene | log2FC | logCPM | LR | PValue | Arabidopsis Annotation | Nicotiana Annotation |
|---|---|---|---|---|---|---|
| c68151_g1_i1 | 0.78 | 8.00 | 9.37 | 0.002201414 | PSAF photosystem I subunit F chr1: 11214824-11216037 | PREDICTED: Photosystem I reaction center subunit III, (LOC104229855) |
| c70874_g1_i3 | 0.77 | 6.00 | 11.61 | 0.000655078 | PSAF photosystem I subunit F chr1: 11214824-11216037 | PREDICTED: Photosystem I reaction center subunit III, LOC104227234) |
| c72380_g2_i1 | 0.82 | 8.81 | 15.30 | 9.19E−05 | ATPC1 ATPase, F1 complex, gamma subunit protein chr4: 2350498-2352018 | PREDICTED: ATP synthase gamma chain, chloroplastic (LOC104212794) |
| c84022_g2_i1 | 1.25 | 6.54 | 19.65 | 9.29E−06 | NA | PREDICTED: Plastocyanin A'/A" (LOC104226609) |
| c80197_g1_i1_1 | 0.66 | 6.27 | 9.60 | 0.00194393 | PSBO-1, OEE1, OEE33, OE33, PSBO1, MSP-1 PS II oxygen-evolving complex 1 | PREDICTED: Oxygen-evolving enhancer protein 1, chloroplastic (LOC104219516) |
| c80359_g2_i3 | 0.74 | 6.41 | 8.91 | 0.002843257 | PSBP-2photosystem II subunit P-2 chr2: 13118937-13120090 | PREDICTED: oxygen-evolving enhancer protein 2-2, (LOC104220111), variant X2 |
| c84616_g2_i1 | 0.95 | 8.53 | 13.93 | 0.000189474 | NA | PREDICTED: Oxygen-evolving enhancer protein 3-2, chloroplastic-like (LOC104238927) |
| c60857_g1_i2_1 | 2.13 | 2.76 | 61.06 | 5.54E−15 | NA | PREDICTED: Ferredoxin, root R-B2-like (LOC104216941), transcript variant X1 |
| c66431_g3_i1 | 2.04 | 1.10 | 26.67 | 2.41E−07 | NA | PREDICTED: Plastocyanin (LOC104222137), mRNA |
| c70844_g1_i1 | 0.72 | 8.77 | 10.45 | 0.001227902 | PSBO-1, OEE1, OEE33, OE33, PSBO1, MSP-1 PS II oxygen-evolving complex 1 chr5:26568653-26570278 | PREDICTED: Oxygen-evolving enhancer protein 1, chloroplastic (LOC104219516), mRNA |
| c72588_g1_i1_1 | 0.58 | 9.38 | 8.50 | 0.003545489 | NA | PREDICTED: Photosystem I reaction center subunit XI, chloroplastic (LOC104221829) |
| c63567_g3_i1 | 0.96 | 8.50 | 15.81 | 7.01E−05 | PSAO photosystem I subunit O chr1: 2640813-2641828 | PREDICTED: Photosystem I subunit O-like (LOC104237017), transcript variant X1 |
| c79260_g1_i1 | 1.76 | 6.42 | 68.73 | 1.13E−16 | PSBO-1, OEE1, OEE33, OE33, PSBO1, MSP-1 PS II oxygen-evolving complex 1 chr5:26568653-26570278 | PREDICTED: Oxygen-evolving enhancer protein 1, chloroplastic-like (LOC104210963), mRNA |
| c70844_g1_i5 | 1.16 | 6.10 | 24.55 | 7.23E−07 | PSBO2, PSBO-2, OEC33 photosystem II subunit O-2 chr3: 18890876-18892426 | PREDICTED: Oxygen-evolving enhancer protein 1, (LOC104210963) |
| c72502_g1_i1 | 0.86 | 4.19 | 12.14 | 0.000493881 | NA | PREDICTED: Oxygen-evolving enhancer protein 1, (LOC104210963) |
| c79863_g1_i3_1 | 1.26 | 2.23 | 13.31 | 0.000263854 | NA | PREDICTED: Plastocyanin A'/A" (LOC104226609) |
| c72380_g1_i1_2 | 0.85 | 8.57 | 20.42 | 6.23E−06 | ATPC1 ATPase, F1 complex, gamma subunit protein chr4: 2350498-2352018 | PREDICTED: ATP synthase gamma chain, chloroplastic (LOC104212794) |
| c66717_g2_i2 | 0.61 | 10.76 | 10.67 | 0.001090419 | NA | PREDICTED: Photosystem II 10 kDa polypeptide, chloroplastic (LOC104224572) |
| c60043_g4_i1 | 3.40 | 1.72 | 78.26 | 9.04E−19 | NA | PREDICTED: Ferredoxin, root R-B2-like (LOC104216941), transcript variant X1 |
| c64427_g1_i1_1 | 0.70 | 9.07 | 8.59 | 0.003381803 | NA | PREDICTED: Photosystem II reaction center W protein, (LOC104244017) |

1. Control conditions: 8 plants were grown with 300 μmol m$^{-2}$ s$^{-1}$ illumination from fluorescent bulbs, with a 12-hour photoperiod;
2. Increased light intensity: 7 plants were grown with 700 μmol m$^{-2}$ s$^{-1}$ illumination from fluorescent bulbs, with a 12-hour photoperiod;
3. Reduced photoperiod: 9 plants were grown with 700 μmol m$^{-2}$ s$^{-1}$ illumination from fluorescent bulbs, with a 8-hour photoperiod;
4. Increased light intensity and photoperiod: 10 plants were grown with 700 μmol m$^{-2}$ s$^{-1}$ illumination from fluorescent bulbs, with a 12-hour photoperiod, at 700 ppm $CO_2$ concentration.

The average data for leaves 9, 15 and 20 of each genotype are plotted in FIG. 11. Increased light intensity alone did not significantly affect the TFA levels. Decreasing the photoperiod from 12 hrs to 8 hrs decreased the levels of TFA but to a surprisingly small extent. That is, even reducing the amount of light received each 24 hours by 33% had remarkably small effect. The most dramatic results observed were from the test using an increased photoperiod under increased light intensity and increased $CO_2$ concentration. The TFA levels increased dramatically, reaching 50% (w/w dry weight) and above in leaves of the LEC2 plants. Since the TFA assays measured only the fatty acid components of lipids, this meant that the total lipid level was even higher in these leaves.

Example 5. Modifying Traits in Vegetative Parts of Monocotyledonous Plants

Chimeric DNA constructs were designed to increase oil content in monocotyledonous plants, for example the C4 plant *S. bicolor* (*sorghum*), by expressing a combination of genes encoding WRI1, *Z. mays* LEC1 (Accession number AAK95562; SEQ ID NO:155), DGAT and Oleosin in the transgenic plants. Several pairs of constructs for biolistic co-transformation were designed and produced by restriction enzyme-ligation cloning, as follows.

The genetic construct pOIL136 was a binary vector containing three monocot expression cassettes, namely a selectable marker gene encoding phosphinothricin acetyltransferase (PAT) for plant selection, a second cassette for expressing DGAT and a third for expressing Oleosin. pJP136 was first produced by amplifying an actin gene promoter from *Oryza sativa* (McElroy et al., 1990) and inserting it as a blunt-ClaI fragment into pORE04 (Coutu et al., 2007) to produce pOIL094. pOIL095 was then produced by inserting a version of the *Sesamum indicum* Oleosin gene which had been codon optimised for monocot expression into pOIL094 at the KpnI site. pOIL093 was produced by cloning a monocot codon optimised version of the *Umbelopsis ramanniana* DGAT2a gene (Lardizabal et al., 2008) as a SmaI-KpnI fragment into a vector already containing a *Zea mays* Ubiquitin gene promoter. pOIL134 was then produced by cloning the NotI DGAT2a expression cassette from pOIL093 into pOIL095 at the NotI sites. pOIL141 was produced by inserting the selectable marker gene coding for PAT as a BamHI-SacI fragment into a vector containing the *Z. mays* Ubiquitin promoter. Finally, pOIL136 was produced by cloning the *Z. mays* Ubiquitin::PAT expression cassette as a blunt-AscI fragment into the ZraI-AscI of pOIL096. The genetic construct pOIL136 therefore contained the following expression cassettes: promoter *O. sativa* Actin::*S. indicum* Oleosin, promoter *Z. mays* Ubiquitin::*U. ramanniana* DGAT2a and promoter *Z. mays* Ubiquitin::PAT.

A similar vector pOIL197, containing NPTII instead of PAT was constructed by subcloning of the *Z. mays* Ubiquitin::NPTII cassette from pUKN as a HindIII-SmaI fragment into the AscI (blunted) and HindIII sites of pJP3343. The resulting vector, pOIL196, was then digested with HindIII (blunted) and AgeI. The resulting 3358 bp fragment was cloned into the ZraI-AgeI sites of pOIL134, yielding pOIL197.

A set of constructs containing genes encoding the *Z. mays* WRI1 (ZmWRT) or the LEC1 (ZmLEC1) transcription factors under the control of different promoters were designed and produced for biolistic co-transformation in combination with pOIL136 or pOIL197 to test the effect of promoter strength and cell specificity on the function of WRI1 or LEC1, or both if combined, when expressed in vegetative tissues of a C4 plant such as *sorghum*. This separate set of constructs did not contain a selectable marker gene, except for pOIL333 which contained NPTII as selectable marker. The different promoters tested were as follows.

The *Z. mays* Ubiquitin gene promoter (pZmUbi) was a strong constitutive monocot promoter while the enhanced CaMV 35S promoter (e35S) having a duplicated enhancer region was reported to result in lower transgene expression levels (reviewed in Girijashankar and Swathisree, 2009). Whilst the *Z. mays* phosphoenolpyruvate carboxylase (pZmPEPC) gene promoter was active in leaf mesophyll cells (Matsuoka and Minami, 1989), the site of photosynthesis in C4 plant species, the *Z. mays* Rubisco small subunit (pZmSSU) gene promoter was specific for the bundle sheath cell layer (Nomura et al., 2000; Lebrun et al., 1987), the cells where carbon fixation takes place in C4 plants.

The expression of the *Z. mays* gene encoding the SEE1 cysteine protease (Accession number AJ494982) was identified as similar to that of the *A. thaliana* SAG12 senescence-specific promoter during plant development. Therefore a 1970 bp promoter from the SEE1 gene (SEQ ID NO:207) was also selected to drive expression of the genes encoding the *Z. mays* WRI1 and LEC1 transcription factors. Further, the promoter from the gene encoding *Aeluropus littoralis* zinc finger protein A1SAP (Ben Saad et al., 2011; Accession number DQ885219; SEQ ID NO:208), the promoter from the gene encoding the *Saccharum* hybrid DIRIGENT (DIR16) (Damaj et al., 2010; Accession number GU062718; SEQ ID NO:246), the promoter from the gene encoding the *Saccharum* hybrid 0-Methyl transferase (OMT) (Damaj et al., 2010; Accession number GU062719; SEQ ID NO:247), the A1 promoter allel from the gene encoding the *Saccharum* hybrid R1MYB1 (Mudge et al., 2009; Accession number JX514703.1; SEQ ID NO:248), the promoter from the gene encoding the *Saccharum* hybrid Loading Stem Gene 5 (LSG5) (Moyle and Birch, 2013; Accession number JX514698.1; SEQ ID NO:249) and the promoter from the sucrose-responsive ArRolC gene from *A. rhizogenes* (Yokoyama et al., 1994; Accession number DQ160187; SEQ ID NO:209) were also selected for expression of ZmWRI1 expression in stem tissue. Therefore, each of these promoters was individually joined upstream of the ZmWRI1 or ZmLEC1 coding regions, as follows.

An intermediate vector, pOIL100, was first produced by cloning the *Z. mays* WRI1 coding sequence and a transcription terminator/polyadenylation region, flanked by AscI-NcoI sites, into the same sites in the binary vector pJP3343. The different versions of the constructs for WRI1 expression were based on this vector and were produced by cloning the various promoters into pOIL100. pOIL101 was produced by cloning a XhoI-SalI fragment containing the e35S promoter with duplicated enhancer region into the XhoI site of pOIL100. pOIL102 was produced by cloning a HindIII-AvrII fragment containing the *Z. mays* Ubiquitin gene promoter into the HindIII-XbaI sites of pOIL100. pOIL103 was produced by cloning a HindIII-NcoI fragment containing a *Z. mays* PEPC gene promoter into the HindIII-NcoI sites of pOIL100. pOIL104 was produced by cloning a HindIII-AvrII fragment containing a *Z. mays* SSU gene promoter into the HindIII-AvrII sites of pOIL100.

A synthetic fragment containing the *Z. mays* SEE1 promoter region flanked by HindIII-XhoI unique sites was synthesized. This fragment was cloned upstream of the *Z. mays* WRI1 protein coding region using the HindIII-XhoI sites in pOIL100. The resulting vector was designated pOIL329. A synthetic fragment containing the *A. littoralis* A1SAP promoter region flanked by XhoI-XbaI unique sites was synthesized. This fragment was cloned upstream of the *Z. mays* WRI1 coding region using the XbaI-XhoI sites in pOIL100. The resulting vector was designated pOIL330. A synthetic fragment containing the *A. rhizogenes* ArRolC promoter region flanked by PspOMI-XhoI unique sites was synthesized. This fragment was cloned upstream of the Z. mays WRI1 coding region using the PspOMI-XhoI sites in pOIL100. The resulting vector was designated pOIL335. Finally, a binary vector (pOIL333) containing the Z. mays SEE1::ZmLEC1 expression cassette was obtained in three steps. First, a 35S::GUS expression vector was constructed by amplifying the GUS coding region with flanking primers containing AvrII and KpnI sites. The resulting fragment was subsequently cloned into the SpeI-KpnI sites of pJP3343. The resulting vector was designated pTV111. Next, the 35S promoter region of pTV111 was replaced by the Z. mays SEE1 promoter. To this end, the Z. mays SEE1 sequence was amplified using flanking primers containing HindIII and XhoI unique sites. The resulting fragment was cut with the respective restriction enzymes and subcloned into the SalI-HindIII sites of pTV111. The resulting vector was designated pOIL332. Next the ZmLEC1 coding sequence was amplified using flanking primers containing NotI and EcoRV sites. This resulting fragment was subcloned into the respective sites of pOIL332, yielding pOIL333.

A 2673 bp synthetic fragment containing the *Saccharum* DIR16 promoter region flanked by HindIII-XbaI sites was synthesized. This fragment was cloned upstream of the Z. mays WRI1 protein coding region using the HindIII-XbaI sites in pOIL100. The resulting vector was designated pOIL337. A 2947 bp synthetic fragment containing the *Saccharum* OMT promoter region flanked by XhoI-XbaI sites was synthesized. This fragment was cloned upstream of the Z. mays WRI1 protein coding region using the XhoI-XbaI sites in pOIL100. The resulting vector was designated pOIL339. A 1181 bp synthetic fragment containing the *Saccharum* R1MYB1 promoter region flanked by HindIII-XhoI sites was synthesized. This fragment was cloned upstream of the Z. mays WRI1 protein coding region using the HindIII-XhoI sites in pOIL100. The resulting vector was designated pOIL341. A 4482 bp synthetic fragment containing the *Saccharum* LSG5 promoter region flanked by XbaIII-SmaI sites was synthesized. This fragment was cloned as an XbaIII-SmaI fragment upstream of the Z. mays WRI1 protein coding region using the StuI-NheI sites in pOIL100. The resulting vector was designated pOIL343.

Whole plasmid DNA was prepared from pOIL101, pOIL102, pOIL103, pOIL104, pOIL197 and pOIL136 for biolistic transformation. pOIL197 DNA was then mixed with either pOIL101, pOIL102, pOIL103 or pOIL104 and transformed by biolistic-mediated transformation into *S. bicolor* (grain sorghum TX430) differentiating embryonic calli (DEC) tissues as described in Example 1. Alternatively, constructs for expression of the same combinations of genes are transformed separately or co-transformed by *Agrobacterium*-mediated transformation (Gurel et al., 2009; Wu et al., 2014) into DEC tissues.

Twenty-five to fifty transgenic plants were regenerated and selected by antibiotic resistance for the pairs of constructs including pOIL197 with each of pOIL102 (pZmUbi::WRI1), pOIL103 (pZmPEPC::WRI1) and pOIL104 (pSSU::WRI1). Transformations were also carried out with pOIL197 alone and with pOIL102 or pOIL103 alone, and for an "empty vector" control. The presence of the desired transgenes in plants that were resistant to the selective agent was demonstrated by PCR. The copy number of each transgene was also determined by digital PCR.

Total leaf lipids were quantified in a first subset of transgenic *S. bicolor* plants prior to their transfer from MS medium to soil. This preliminary screening suggested slightly elevated total lipid levels in leaf tissue of some events at this very early stage. The line with the highest total lipid content, pOIL136 (2), was further analyzed by thin layer chromatography (TLC) to determine the effect of transgene expression on TAG accumulation. Leaf tissue of this particular line was sampled at vegetative stage following transfer to soil in the glasshouse. When compared to the wildtype and empty vector negative controls, pOIL136 (2) exhibited increased TAG levels in leaf tissue after TLC separation and iodine staining. Subsequent quantification revealed 10-fold increased TAG in the transgenic line compared to the negative controls. The TAG profile was dominated by the polyunsaturated fatty acids linoleic and α-linolenic acid.

After confirmed transgenic plants were transferred to soil in pots in the glasshouse, whole leaves were sampled from primary transformants at vegetative stage of growth (i.e. prior to the appearance of the boot leaf), at the boot leaf stage (defined as when the boot leaf has fully emerged, the boot leaf is the last leaf formed on the plant and from which the panicle (head) emerges) and at the mature seed-setting stage. Total fatty acid (TFA) and triacylglycerol (TAG) contents (% leaf dry weight) were quantified by TLC-GC as described in Example 1.

TFA levels in wildtype and empty vector negative controls decreased during plant development (Table 11) and were in the range 0.7-3.3% (weight/dry weight). The highest TFA levels were detected prior to the appearance of the boot leaf (termed the vegetative stage of growth) and were not higher than 3.3%. TAG levels in the same plants were consistently low in the range 0-0.2% during the entire plant life cycle (Table 11). Both the TFA content and the TAG content had fatty acid compositions of predominantly C16:0, $C18:2^{\Delta 9,12}$ (LA) and $C18:3^{\Delta 9,12,15}$ (ALA). In particular, ALA was present at about 50-75% of the TFA content, reflecting the use of this fatty acid in wild-type plastid membranes. ALA also was the main fatty acid in the very small amount of TAG present in the wild-type leaves.

Thirty-five confirmed transgenic plants which had been transformed with pOIL197 or pOIL136, each vectors comprising both pZmUbi:DGAT and pZmUbi:Oleosin genes in addition to the selectable marker genes, were analysed at the vegetative, boot leaf and mature seed setting stages. The data are presented in Tables 12-14. Generally, the pOIL197 and pOIL136 primary transformants displayed increased TFA and TAG accumulation compared to the negative control lines, but only to about double for the TFA level compared to the controls. The highest TFA levels were detected at the vegetative stage of growth (Table 12). Similar to the wild-type and negative control lines, TFA levels decreased with progressing plant age (Tables 13 and 14). Maximum TFA levels at vegetative, boot leaf and mature seed setting stages equalled 5%, 4.5% and 2.1%, respectively. The highest TAG levels detected varied between 0.9 and 1.9% depending on the age of the plant at the time of sampling (Table 13), so were increased up to 10-fold relative to the very low levels in the wild-type leaves (Table 11). The TFA composition remained largely unchanged at the different stages and was dominated by ALA. The TAG composition displayed a higher degree of variation between the different transgenic lines. Compared to the fatty acid composition of the TFA content, the levels of stearic acid, oleic acid and LA (18:$2^{\Delta 9,12}$) consistently increased in TAG throughout all plant stages investigated.

Nine primary transgenic plants made by transformation with pOIL102 (pZmUbi:WRI1) were generated by co-bombardment of pOIL102 and pUKN, containing the NPTII selectable marker gene. Tables 15-17 show the data for TFA and TAG contents and fatty acid compositions were measured at the three growth stages. When compared to the plants transformed with the constructs encoding DGAT and Oleosin (pOIL197 or pOIL136), TFA and TAG levels in the pOIL102 transgenic events were generally lower. Indeed, levels of TFA and TAG were similar to the levels in the wild-type and negative control plants. Maximum TFA levels at vegetative, boot leaf and mature seed setting stages were 2.6%, 2.5% and 2.0%, respectively (Tables 15-17). Maximum TAG levels observed were 0.2%, 0.4% and 0.9% at vegetative, boot leaf and mature seed setting stages, respectively.

Thirty-six primary transgenic plants made by co-bombardment with both pOIL197 (pZmUbi:DGAT and pZmUbi:Oleosin) and pOIL102 (pZmUbi:WRI1) and confirmed to have integrated both genetic constructs were analysed for TFA and TAG contents and fatty acid composition at the three growth stages. The data are presented in Tables 18-20. Some of the plants exhibited greatly increased TFA and TAG levels compared to the transformations with single pOIL197, pOIL136 or pOIL102 vectors. Maximum TFA levels at vegetative, boot leaf and mature seed setting stages in the pOIL102+pOIL197 population equalled 7.2%, 6.4% and 6.1%, respectively (Tables 18-20). Importantly, the maximum observed TAG levels increased during plant development from 2.7% (vegetative stage) to 3.5% (boot leaf stage) and 4.3% (mature seed setting stage) (Tables 18-20). Compared with the data obtained for the separate transformations with the DGAT and WRI1 transgenes, this exemplified the synergism for co-expressing DGAT and WRI1 transgenes to increase non-polar lipid accumulation in vegetative plant tissues. High levels of TAG and TFA were in most cases associated with a substantial reduction in the $C18:3^{\Delta 9,12,15}$ content, which was reduced by about 50% in the lines with the highest levels of TAG.

Thirty-six primary transformants containing both pOIL197 (pZmUbi:DGAT and pZmUbi:Oleosin) and pOIL103 (pZmPEPC:WRI1) were analysed for TFA and TAG contents and fatty acid composition during the three stages of plant development. The data are presented in Tables 21-23. Some plants with this gene combination exhibited the highest TFA and TAG levels detected in this experimental series. TFA levels were observed at vegetative, boot leaf and mature seed setting stages in the pOIL103+pOIL197 population at 8.3%, 8.3% and 4.5%, respectively (Tables 21-23). TAG levels were observed at vegetative, boot leaf and mature seed setting stages at 2.3%, 6.6% and 3.0%, respectively (Tables 21-23). Of note, the highest TAG (6.6%) and TFA (8.3%) levels amongst all transgenic lines were detected in event TX-03-31 at boot leaf stage. While $C18:3^{\Delta 9,12,15}$ typically dominated the TFA fraction, TAG compositions in this population displayed a high degree of variability. Of note, some events exhibited increases in levels of palmitic acid (C16:0) and/or linoleic acid (LA, $C18:2^{\Delta 9,12}$) at the expense of ALA. Indeed, the ALA level in both TFA and TAG contents was reduced below 40% in some events, less than 30% in selected events. The ALA level in TAG was less than 20% in some selected events.

Plants containing the higher levels of TFA and TAG were propagated by separating tillers and transplanting them into soil in new pots. The tillers produced new roots and continued to grow. When leaf samples of the new plants were analysed, TAG levels of 8.3% in a TFA level of 9.3% were observed.

Sixteen primary transformants containing both pOIL197 (pZmUbi:DGAT and pZmUbi:Oleosin) and pOIL104 (pSSU:WRI1) were analysed for TFA and TAG contents and fatty acid composition. Leaves of primary transformants containing both pOIL197 and pOIL104 T-DNA regions, sampled at vegetative stage of growth were observed with 4.1% and 5.9% TFA (Table 24). Surprisingly, the highest TFA levels detected in this population were accompanied by a relatively low TAG content. TAG levels in pOIL104+pOIL197 transgenic plants at vegetative and boot leaf stages reached only to 0.6% and 2.8%. Increased TAG levels were typically associated with a reduction in $C18:3^{\Delta 9,12,15}$ and an increase in both palmitic acid and LA.

The TFA and TAG levels in many independent transformed plants are shown schematically in FIG. 19.

Expression levels of the WRI1 and DGAT1 genes in a number of plants were measured by a RT-PCR method. It was observed that plant TX-03-31 which had a relatively high TTQ had the highest level of expression of DGAT amongst the tested plants. It was concluded that high levels of DGAT expression were beneficial for increasing the TAG level and also the TTQ.

Perhaps the most surprising and unexpected conclusion drawn from the large amount of data in this Example was the relatively high level of TFA accompanied by the low levels of TAG, except in a few exceptional plants such as plant TX-03-31 (Table 22). That is, although substantially much increased fatty acid synthesis was occurring, much of the increased fatty acid was not appearing as TAG. This conclusion was completely the opposite of what had been observed with the WRI1+DGAT transgenic plants for *Nicotiana* including tobacco. To quantitate this in the *sorghum* plants, the quotient of the TAG to TFA level was calculated for all of the above mentioned transgenic *sorghum* populations (Tables 11-24). The TAG/TFA Quotient (TTQ) parameter was calculated as the level of TAG (%) divided by the level of TFA (%), each as a percentage of the dry weight of the plant material (leaf in this case). It was observed that for many of the *sorghum* lines, the TTQ was in the range of 0.01 to 0.6. Addition of one or more further genetic modifications to the plants which provide for a reduction in the level of SDP1, TGD or TST, or an increase in the levels of one or more of PDAT, PDCT or CPT polypeptides increases the TTQ to above 0.6 for a larger proportion of the plant lines. In particular, reduction in TAG lipase in the plants increases the TTQ to up to 0.95.

Due to the large difference in absolute TFA and TAG levels in many transgenic lines, the inventors selected two pOIL102+pOIL197 events for quantification of the major neutral and polar lipid classes, to determine the type of lipid in which the high level of fatty acids was present. The types of lipid were separated by TLC and quantitated. At the vegetative stage of growth, TX-02-8 and TX-02-19 contained 4.5% and 7.2% TFA, respectively (Table 18). TAG content was only slightly increased in the TX-02-8 leaves while the levels of phosphatidylcholine (PC, a phospholipid) and the galactolipid MGDG were comparable to the negative controls. TX-02-19 exhibited increased TAG, PC and MGDG levels, indicating an increase in both neutral and polar lipid classes.

A more detailed lipid analysis was performed on the TX-03-8 plant (boot leaf stage) and TX-03-28 (vegetative stage) (FIG. 13). A wildtype (flowering) and empty vector transformant (vegetative stage) served as controls for comparison. Despite differences in plant age at the time of sampling, leaves of both transgenic plants contained increased levels of TFA and total polar lipids. TX-03-28 contained up to 3.4% TAG at vegetative stage while TAG levels in TX-03-8 were only slightly increased at boot leaf stage. Both transgenic lines exhibited surprisingly large increases in the amounts of the galactolipids MGDG and DGDG. Increases in different polar lipid classes, the phospholipids PC, PG, PE, PA, PS, PI, were less pronounced but still significant (FIG. 13B). Further investigation by LC-MS revealed increased levels of C18:0, C18:2$^{\Delta9,12}$ and C18:3$^{\Delta9,12,15}$ in the free fatty acid fraction of both transgenic lines, suggesting a flux through PC via acyl editing prior to lipolysis. DAG molecular species in transgenic leaf tissues that were increased included 34:2 (likely C16:0/C18:2$^{\Delta9,12}$), 34:3 (likely C16:0/C18:3$^{\Delta9,12,15}$), 36:4 (likely C18:2$^{\Delta9,12}$/C18:2$^{\Delta9,12}$ and C18:1$^{\Delta9}$/C18:3$^{\Delta9,12,15}$) and 36:5 (likely C18:2$^{\Delta9,12}$/C18:3$^{\Delta9,12,15}$). The enrichment of poly-unsaturated fatty acids in the DAG fraction matched with the TAG composition and suggested PC-derived DAG as the precursor to TAG synthesis. Similar changes in PC and PE molecular species were observed in both transgenic plants while PI species mainly had C16:0 and C18 fatty acids. PG molecular species were highly enriched in C16:0, reflecting their plastidial synthesis via the prokaryotic pathway. Galactolipids in both transgenic lines were mainly derived from the eukaryotic lipid pathway i.e. enriched in C18 fatty acids. The major MGDG molecular species was 36:6 (likely C18:3$^{\Delta9,12,15}$/C18:3$^{\Delta9,12,15}$), serving as a substrate for DGDG 36:6 synthesis. A second major DGDG species in both transgenic lines, 34:3 (likely C16:0/C18:3$^{\Delta9,12,15}$), was also likely from extra-plastidial origin. TAG molecular species consisting of C16/C16/C18 (48:X), C16/C16/C18 (50:X) and C16/C18/C18 (52:x) were increased in transgenic leaf tissues. Interestingly, 54:8 (likely C18:2$^{\Delta9,12}$/C18:3$^{\Delta9,12,15}$/C18: 3$^{\Delta9,12,15}$) and 54:9 (likely C18:3$^{\Delta9,12,15}$/C18:3$^{\Delta9,12,15}$/C18:3$^{\Delta9,12,15}$) were reduced compared to the negative controls. Taken together, these results suggest increased flux of acyl chains into TAG via PC in the transgenic lines whilst galactolipid biosynthesis mainly occured via the eukaryotic pathway. These data also led the inventors to understand that reduction of TGD activity or increases in PDCT and/or CPT in the plants in addition to the present transgenes would likely enhance the TFA and TAG levels.

The chimeric DNA constructs for *Agrobacterium*-mediated transformation are used to transform *Zea mays* (corn) as described by Gould et al. (1991). Briefly, shoot apex explants are co-cultivated with transgenic *Agrobacterium* for two days before being transferred onto a MS salt media containing kanamycin and carbenicillin. After several rounds of sub-culture, transformed shoots and roots spontaneously form and are transplanted to soil. The constructs are similarly used to transform *Hordeum vulgare* (barley) and *Avena sativa* (oats) using transformation methods known for these species. Briefly, for barley, the *Agrobacterium* cultures are used to transform cells in immature embryos of barley (cv. Golden Promise) according to published methods (Tingay et al., 1997; Bartlett et al., 2008) with some modifications in that embryos between 1.5 and 2.5 mm in length are isolated from immature caryopses and the embryonic axes removed. The resulting explants are co-cultivated for 2-3 days with the transgenic *Agrobacterium* and then cultured in the dark for 4-6 weeks on media containing timentin and hygromycin to generate embryogenic callus before being moved to transition media in low light conditions for two weeks. Calli are then transferred to regeneration media to allow for the regeneration of shoots and roots before transfer of the regenerated plantlets to soil. Transformed plants are obtained and grown to maturity in the glasshouse.

TABLE 11

TFA and TAG levels, fatty acid composition and TTQ in wild-type (WT) and empty vector (EV) negative controls during different stages of plant development.

| Stage | Line | TAG or TFA | C16:0 | C18:0 | C18:1 | C18:2 | C18:3 | Other | TFA | TAG | TTQ |
|---|---|---|---|---|---|---|---|---|---|---|---|
| Veg | WT1 | TFA | 9.9 | 1.2 | 0.7 | 8.8 | 75.4 | 4.0 | 1.7 | | |
| Veg | WT1 | TAG | 22.5 | 3.6 | 3.0 | 31.8 | 37.4 | 1.6 | | 0.0 | 0.027 |
| Veg | WT2 | TFA | 12.0 | 1.7 | 0.7 | 8.5 | 73.0 | 4.2 | 2.2 | | |
| Veg | WT2 | TAG | 12.1 | 3.2 | 2.1 | 29.0 | 52.3 | 1.4 | | 0.1 | 0.028 |
| Veg | WT3 | TFA | 15.3 | 1.5 | 0.7 | 10.0 | 69.8 | 2.7 | 2.7 | | |
| Veg | WT3 | TAG | 17.4 | 6.5 | 2.6 | 27.2 | 38.0 | 8.3 | | 0.0 | 0.000 |
| Veg | WT6 | TFA | 12.2 | 1.8 | 0.5 | 7.7 | 72.8 | 5.1 | 3.3 | | |
| Veg | WT6 | TAG | 18.8 | 6.8 | 3.7 | 17.4 | 44.7 | 8.5 | | 0.1 | 0.017 |
| Veg | EV1 | TFA | 13.0 | 2.1 | 0.9 | 9.6 | 70.6 | 3.8 | 2.0 | | |
| Veg | EV1 | TAG | 6.5 | 2.8 | 1.6 | 19.2 | 51.4 | 18.5 | | 0.2 | 0.090 |
| Veg | EV3 | TFA | 12.1 | 1.9 | 0.9 | 9.4 | 72.7 | 3.0 | 2.1 | | |
| Veg | EV3 | TAG | 9.7 | 3.8 | 2.3 | 25.1 | 57.6 | 1.6 | | 0.1 | 0.056 |
| BL | EV1 | TFA | 17.6 | 1.9 | 1.5 | 14.7 | 59.0 | 5.4 | 1.5 | | |
| BL | EV1 | TAG | 17.5 | 6.5 | 3.7 | 30.7 | 35.6 | 5.9 | | 0.0 | 0.031 |
| BL | WT3 | TFA | 14.4 | 3.9 | 2.4 | 11.1 | 62.6 | 5.6 | 1.1 | | |
| BL | WT3 | TAG | 9.4 | 4.8 | 4.0 | 19.1 | 61.2 | 1.6 | | 0.2 | 0.153 |
| MSS | WT3 | TFA | 14.2 | 3.9 | 2.2 | 10.2 | 63.6 | 5.9 | 1.2 | | |
| MSS | WT3 | TAG | 15.3 | 12.5 | 3.9 | 18.2 | 43.9 | 6.2 | | 0.1 | 0.067 |
| MSS | EV3 | TFA | 16.5 | 5.0 | 1.6 | 12.7 | 50.6 | 13.6 | 0.7 | | |
| MSS | EV3 | TAG | 13.4 | 11.4 | 2.6 | 19.6 | 50.0 | 3.0 | | 0.1 | 0.192 |

Veg: Vegetative;

BL, Boot leaf stage of growth;

MSS, Mature seed setting stage

TABLE 12

TFA and TAG levels, fatty acid composition and TTQ in sorghum leaves transformed with pOIL197 or pOIL136 (pZmUbi:DGAT; pZmUbi:Oleosin) during the vegetative stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-197-18 | TFA | 16.3 | 3.7 | 1.7 | 13.3 | 59.7 | 5.3 | 0.7 | | |
| TX-197-18 | TAG | 13.9 | 5.0 | 2.7 | 22.2 | 53.0 | 3.3 | | 0.1 | 0.188 |
| TX-197-12 | TFA | 15.4 | 2.5 | 1.6 | 13.8 | 56.7 | 10.0 | 1.0 | | |
| TX-197-12 | TAG | 12.6 | 4.0 | 3.5 | 28.6 | 47.8 | 3.4 | | 0.1 | 0.106 |
| TX-197-04 | TFA | 12.8 | 3.7 | 1.5 | 9.2 | 65.4 | 7.4 | 1.2 | | |
| TX-197-04 | TAG | 8.0 | 5.0 | 3.1 | 16.6 | 65.3 | 2.1 | | 0.2 | 0.169 |
| TX-136-03 | TFA | 13.9 | 2.2 | 2.0 | 11.7 | 65.5 | 4.8 | 1.2 | | |
| TX-136-03 | TAG | 12.1 | 3.8 | 4.2 | 27.8 | 50.5 | 1.6 | | 0.1 | 0.064 |
| TX-197-06 | TFA | 13.8 | 2.7 | 1.7 | 10.9 | 63.3 | 7.5 | 1.2 | | |
| TX-197-06 | TAG | 9.8 | 4.0 | 3.5 | 22.6 | 56.6 | 3.4 | | 0.1 | 0.107 |
| TX-197-20 | TFA | 15.3 | 2.6 | 1.5 | 12.1 | 61.4 | 7.2 | 1.2 | | |
| TX-197-20 | TAG | 13.5 | 4.2 | 3.3 | 25.5 | 50.3 | 3.1 | | 0.1 | 0.085 |
| TX-136-24 | TFA | 12.2 | 2.0 | 1.6 | 10.9 | 69.0 | 4.3 | 1.5 | | |
| TX-136-24 | TAG | 11.7 | 3.3 | 3.0 | 23.3 | 55.9 | 2.8 | | 0.4 | 0.243 |
| TX-197-16 | TFA | 14.4 | 2.2 | 1.7 | 13.5 | 61.1 | 7.2 | 1.9 | | |
| TX-197-16 | TAG | 14.8 | 3.5 | 3.2 | 25.3 | 47.9 | 5.3 | | 0.4 | 0.235 |
| TX-197-05 | TFA | 12.2 | 2.3 | 1.3 | 9.9 | 68.2 | 6.1 | 2.0 | | |
| TX-197-05 | TAG | 10.4 | 4.3 | 2.9 | 21.0 | 58.7 | 2.7 | | 0.1 | 0.070 |
| TX-197-17 | TFA | 14.0 | 2.2 | 2.4 | 19.5 | 55.4 | 6.5 | 2.1 | | |
| TX-197-17 | TAG | 13.7 | 3.3 | 4.4 | 33.8 | 40.4 | 4.4 | | 0.6 | 0.264 |
| TX-197-22 | TFA | 11.9 | 1.7 | 0.9 | 8.5 | 71.6 | 5.4 | 2.1 | | |
| TX-197-22 | TAG | 11.5 | 4.3 | 2.4 | 23.9 | 55.2 | 2.8 | | 0.1 | 0.041 |
| TX-197-21 | TFA | 10.8 | 1.6 | 0.9 | 7.9 | 73.3 | 5.5 | 2.4 | | |
| TX-197-21 | TAG | 9.9 | 3.8 | 2.6 | 24.2 | 57.0 | 2.5 | | 0.1 | 0.045 |
| TX-197-10 | TFA | 10.5 | 1.5 | 0.8 | 9.3 | 72.8 | 5.2 | 2.7 | | |
| TX-197-10 | TAG | 9.0 | 2.8 | 2.4 | 26.6 | 55.6 | 3.7 | | 0.2 | 0.078 |
| TX-197-50 | TFA | 12.9 | 1.8 | 1.0 | 10.8 | 68.1 | 5.3 | 2.8 | | |
| TX-197-50 | TAG | 14.7 | 4.4 | 2.5 | 23.1 | 48.8 | 6.6 | | 0.3 | 0.107 |
| TX-197-07 | TFA | 10.5 | 1.4 | 0.8 | 10.1 | 71.8 | 5.4 | 2.8 | | |
| TX-197-07 | TAG | 9.6 | 2.9 | 2.5 | 31.3 | 49.6 | 4.1 | | 0.2 | 0.067 |
| TX-197-48 | TFA | 13.2 | 1.8 | 1.2 | 11.4 | 67.0 | 5.4 | 2.8 | | |
| TX-197-48 | TAG | 10.1 | 3.1 | 2.5 | 25.5 | 53.1 | 5.6 | | 0.3 | 0.104 |
| TX-197-08 | TFA | 11.4 | 1.1 | 1.4 | 12.4 | 68.1 | 5.6 | 2.9 | | |
| TX-197-08 | TAG | 15.9 | 3.7 | 6.1 | 45.2 | 23.2 | 5.8 | | 0.1 | 0.027 |
| TX-197-13 | TFA | 10.8 | 1.6 | 0.7 | 8.0 | 73.5 | 5.4 | 2.9 | | |
| TX-197-13 | TAG | 10.5 | 3.6 | 2.2 | 24.1 | 51.2 | 8.4 | | 0.1 | 0.037 |
| TX-197-15 | TFA | 10.5 | 1.3 | 0.7 | 8.9 | 73.0 | 5.6 | 2.9 | | |
| TX-197-15 | TAG | 9.6 | 2.8 | 2.2 | 26.9 | 55.3 | 3.3 | | 0.2 | 0.067 |
| TX-136-02 | TFA | 12.5 | 1.5 | 1.3 | 14.3 | 66.1 | 4.3 | 2.9 | | |
| TX-136-02 | TAG | 14.0 | 2.6 | 2.7 | 27.3 | 48.4 | 5.0 | | 0.7 | 0.245 |
| TX-197-19 | TFA | 10.9 | 1.4 | 0.8 | 9.1 | 73.0 | 4.8 | 3.1 | | |
| TX-197-19 | TAG | 11.1 | 3.0 | 2.3 | 27.3 | 52.6 | 3.6 | | 0.2 | 0.063 |
| TX-197-40 | TFA | 9.9 | 1.1 | 0.5 | 8.2 | 77.4 | 3.0 | 3.1 | | |
| TX-197-40 | TAG | 15.4 | 6.3 | 2.3 | 27.1 | 46.7 | 2.2 | | 0.0 | 0.008 |
| TX-197-47 | TFA | 11.9 | 2.0 | 0.7 | 7.3 | 73.0 | 5.2 | 3.2 | | |
| TX-197-47 | TAG | 10.4 | 3.6 | 2.4 | 19.7 | 60.1 | 3.8 | | 0.1 | 0.028 |
| TX-197-49 | TFA | 12.0 | 1.7 | 2.1 | 16.0 | 63.1 | 5.1 | 3.2 | | |
| TX-197-49 | TAG | 13.5 | 3.8 | 6.6 | 36.9 | 31.9 | 7.3 | | 0.3 | 0.085 |
| TX-197-28 | TFA | 11.1 | 1.3 | 0.4 | 8.0 | 75.6 | 3.5 | 3.2 | | |
| TX-197-28 | TAG | 17.5 | 4.9 | 1.3 | 22.3 | 47.4 | 6.6 | | 0.1 | 0.024 |
| TX-197-14 | TFA | 9.8 | 1.2 | 0.8 | 10.2 | 72.8 | 5.2 | 3.3 | | |
| TX-197-14 | TAG | 9.4 | 2.7 | 3.5 | 39.4 | 39.5 | 5.5 | | 0.1 | 0.045 |
| TX-197-51 | TFA | 12.5 | 2.0 | 1.0 | 10.6 | 68.3 | 5.6 | 3.4 | | |
| TX-197-51 | TAG | 14.0 | 4.5 | 2.3 | 22.4 | 49.8 | 7.0 | | 0.4 | 0.122 |
| TX-136-01 | TFA | 12.5 | 1.5 | 1.3 | 13.3 | 69.1 | 2.3 | 3.4 | | |
| TX-136-01 | TAG | 15.0 | 3.1 | 2.8 | 27.8 | 44.9 | 6.4 | | 0.8 | 0.234 |
| TX-197-11 | TFA | 10.2 | 1.1 | 0.9 | 11.2 | 71.1 | 5.5 | 3.5 | | |
| TX-197-11 | TAG | 12.2 | 3.3 | 4.6 | 43.3 | 30.0 | 6.6 | | 0.1 | 0.034 |
| TX-197-33 | TFA | 10.9 | 1.4 | 0.4 | 8.0 | 75.7 | 3.6 | 3.5 | | |
| TX-197-33 | TAG | 14.0 | 4.7 | 1.6 | 20.4 | 53.0 | 6.3 | | 0.1 | 0.025 |
| TX-136-25 | TFA | 13.1 | 2.4 | 0.6 | 11.5 | 67.5 | 4.9 | 3.8 | | |
| TX-136-25 | TAG | 15.8 | 4.4 | 1.2 | 21.1 | 49.7 | 7.8 | | 0.8 | 0.202 |
| TX-197-09 | TFA | 10.5 | 1.3 | 0.7 | 9.4 | 73.0 | 5.1 | 3.8 | | |
| TX-197-09 | TAG | 11.5 | 3.5 | 2.4 | 30.4 | 48.4 | 3.9 | | 0.2 | 0.047 |
| TX-197-30 | TFA | 11.8 | 1.7 | 0.6 | 8.9 | 73.0 | 4.0 | 3.8 | | |
| TX-197-30 | TAG | 15.3 | 4.1 | 1.6 | 22.0 | 51.3 | 5.7 | | 0.2 | 0.051 |
| TX-197-23 | TFA | 10.5 | 1.4 | 1.4 | 14.1 | 67.5 | 5.1 | 4.3 | | |
| TX-197-23 | TAG | 13.1 | 3.0 | 3.7 | 36.3 | 38.7 | 5.3 | | 0.8 | 0.175 |
| TX-197-37 | TFA | 10.3 | 2.0 | 2.4 | 18.6 | 62.8 | 3.9 | 5.0 | | |
| TX-197-37 | TAG | 12.9 | 4.0 | 6.2 | 38.7 | 31.6 | 6.7 | | 1.2 | 0.230 |

TABLE 13

TFA and TAG levels, fatty acid composition and TTQ in sorghum leaves transformed with pOIL197 or pOIL136 (pZmUbi:DGAT; pZmUbi:Oleosin) during the boot leaf stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-197-14 | TFA | 12.7 | 5.2 | 2.0 | 14.4 | 57.7 | 8.1 | 1.2 | | |
| TX-197-14 | TAG | 8.8 | 7.1 | 3.1 | 22.7 | 54.7 | 3.6 | | 0.3 | 0.266 |
| TX-197-15 | TFA | 14.5 | 5.0 | 2.3 | 14.7 | 55.8 | 7.7 | 1.2 | | |
| TX-197-15 | TAG | 12.7 | 7.1 | 3.2 | 21.0 | 51.7 | 4.3 | | 0.3 | 0.262 |
| TX-197-19 | TFA | 13.1 | 3.2 | 2.0 | 14.3 | 60.9 | 6.4 | 1.2 | | |
| TX-197-19 | TAG | 10.6 | 4.3 | 3.4 | 24.4 | 54.0 | 3.2 | | 0.2 | 0.203 |
| TX-136-03 | TFA | 14.1 | 1.8 | 1.7 | 12.6 | 65.0 | 4.8 | 1.2 | | |
| TX-136-03 | TAG | 14.5 | 4.3 | 4.5 | 32.9 | 42.2 | 1.6 | | 0.1 | 0.045 |
| TX-197-08 | TFA | 14.4 | 3.5 | 1.3 | 14.2 | 62.2 | 4.4 | 1.2 | | |
| TX-197-08 | TAG | 13.7 | 5.2 | 2.7 | 22.4 | 50.5 | 5.5 | | 0.3 | 0.211 |
| TX-197-11 | TFA | 14.1 | 3.8 | 2.0 | 15.0 | 57.0 | 8.2 | 1.3 | | |
| TX-197-11 | TAG | 10.3 | 4.8 | 3.0 | 22.8 | 55.9 | 3.1 | | 0.3 | 0.267 |
| TX-136-24 | TFA | 15.5 | 2.2 | 2.2 | 16.9 | 58.1 | 5.2 | 1.3 | | |
| TX-136-24 | TAG | 14.7 | 3.3 | 4.0 | 32.4 | 42.9 | 2.7 | | 0.2 | 0.164 |
| TX-136-02 | TFA | 12.3 | 1.5 | 1.4 | 14.7 | 65.7 | 4.4 | 1.5 | | |
| TX-136-02 | TAG | 13.9 | 2.7 | 3.0 | 28.7 | 46.6 | 5.1 | | 0.7 | 0.444 |
| TX-197-30 | TFA | 13.1 | 2.3 | 1.3 | 9.3 | 65.1 | 8.8 | 2.0 | | |
| TX-197-30 | TAG | 10.0 | 3.0 | 2.2 | 15.0 | 65.3 | 4.5 | | 0.4 | 0.223 |
| TX-197-46 | TFA | 13.2 | 2.5 | 0.8 | 7.9 | 71.2 | 4.5 | 2.0 | | |
| TX-197-46 | TAG | 17.3 | 18.6 | 3.2 | 14.7 | 42.5 | 3.7 | | 0.1 | 0.033 |
| TX-197-45 | TFA | 13.6 | 2.7 | 0.6 | 6.7 | 71.7 | 4.5 | 2.1 | | |
| TX-197-45 | TAG | 22.7 | 17.7 | 4.4 | 12.9 | 38.6 | 3.6 | | 0.1 | 0.030 |
| TX-197-39 | TFA | 12.6 | 3.6 | 1.1 | 9.0 | 66.2 | 7.4 | 2.1 | | |
| TX-197-39 | TAG | 9.5 | 4.0 | 1.6 | 12.8 | 66.7 | 5.5 | | 0.6 | 0.291 |
| TX-197-22 | TFA | 13.6 | 2.0 | 0.8 | 7.3 | 71.3 | 4.9 | 2.1 | | |
| TX-197-22 | TAG | 13.8 | 3.3 | 1.8 | 14.2 | 64.6 | 2.3 | | 0.1 | 0.056 |
| TX-197-34 | TFA | 12.0 | 3.2 | 1.2 | 9.6 | 67.9 | 5.9 | 2.2 | | |
| TX-197-34 | TAG | 9.1 | 4.6 | 2.3 | 18.4 | 63.2 | 2.3 | | 0.4 | 0.190 |
| TX-197-50 | TFA | 13.0 | 2.5 | 1.1 | 9.1 | 66.8 | 7.5 | 2.5 | | |
| TX-197-50 | TAG | 11.4 | 4.6 | 2.1 | 15.3 | 59.8 | 6.9 | | 0.5 | 0.183 |
| TX-197-43 | TFA | 12.4 | 2.3 | 0.7 | 8.0 | 71.9 | 4.7 | 2.5 | | |
| TX-197-43 | TAG | 11.0 | 4.4 | 1.8 | 15.7 | 62.3 | 4.8 | | 0.2 | 0.065 |
| TX-197-32 | TFA | 12.5 | 2.1 | 1.1 | 9.0 | 70.0 | 5.3 | 2.5 | | |
| TX-197-32 | TAG | 12.8 | 3.7 | 2.1 | 16.1 | 60.3 | 5.0 | | 0.6 | 0.220 |
| TX-197-33 | TFA | 12.1 | 2.7 | 0.7 | 7.9 | 71.0 | 5.6 | 2.5 | | |
| TX-197-33 | TAG | 11.1 | 4.8 | 1.4 | 15.4 | 62.4 | 4.9 | | 0.3 | 0.130 |
| TX-197-41 | TFA | 12.8 | 1.9 | 0.7 | 8.1 | 72.8 | 3.7 | 2.6 | | |
| TX-197-41 | TAG | 15.1 | 5.9 | 2.4 | 16.7 | 53.7 | 6.3 | | 0.2 | 0.065 |
| TX-197-36 | TFA | 12.2 | 2.0 | 0.8 | 7.7 | 71.6 | 5.6 | 2.6 | | |
| TX-197-36 | TAG | 11.4 | 3.4 | 1.6 | 13.9 | 65.6 | 4.1 | | 0.4 | 0.158 |
| TX-197-42 | TFA | 12.4 | 2.1 | 0.8 | 8.2 | 70.3 | 6.3 | 2.7 | | |
| TX-197-42 | TAG | 12.4 | 5.4 | 2.3 | 17.8 | 57.1 | 5.0 | | 0.2 | 0.060 |
| TX-197-51 | TFA | 13.6 | 2.1 | 1.0 | 9.9 | 66.8 | 6.6 | 2.7 | | |
| TX-197-51 | TAG | 13.1 | 4.6 | 3.0 | 18.8 | 53.4 | 7.0 | | 0.5 | 0.175 |
| TX-197-49 | TFA | 15.2 | 2.9 | 1.0 | 9.3 | 65.3 | 6.3 | 2.7 | | |
| TX-197-49 | TAG | 17.3 | 5.0 | 2.0 | 16.7 | 52.7 | 6.3 | | 0.5 | 0.192 |
| TX-197-48 | TFA | 13.0 | 2.3 | 1.0 | 8.8 | 68.5 | 6.4 | 2.8 | | |
| TX-197-48 | TAG | 13.0 | 4.7 | 2.2 | 16.1 | 58.0 | 6.0 | | 0.4 | 0.144 |
| TX-197-38 | TFA | 12.2 | 2.0 | 1.0 | 7.7 | 72.1 | 5.0 | 2.9 | | |
| TX-197-38 | TAG | 11.2 | 3.4 | 2.2 | 14.9 | 63.8 | 4.5 | | 0.5 | 0.160 |
| TX-197-35 | TFA | 12.8 | 1.8 | 0.9 | 8.5 | 69.4 | 6.6 | 2.9 | | |
| TX-197-35 | TAG | 12.7 | 2.9 | 1.7 | 14.5 | 63.3 | 4.9 | | 0.7 | 0.227 |
| TX-197-40 | TFA | 12.7 | 1.9 | 0.7 | 7.7 | 73.9 | 3.1 | 2.9 | | |
| TX-197-40 | TAG | 16.3 | 4.7 | 3.3 | 20.8 | 52.4 | 2.6 | | 0.1 | 0.031 |
| TX-197-47 | TFA | 13.9 | 2.4 | 0.6 | 6.9 | 72.2 | 3.9 | 2.9 | | |
| TX-197-47 | TAG | 24.6 | 19.8 | 5.2 | 10.7 | 34.8 | 4.9 | | 0.0 | 0.017 |
| TX-136-01 | TFA | 11.6 | 1.4 | 1.3 | 14.1 | 67.2 | 4.3 | 3.3 | | |
| TX-136-01 | TAG | 14.6 | 2.9 | 3.0 | 29.5 | 44.1 | 5.9 | | 0.7 | 0.199 |
| TX-197-44 | TFA | 13.5 | 2.1 | 1.4 | 14.7 | 63.1 | 5.1 | 3.4 | | |
| TX-197-44 | TAG | 14.4 | 4.3 | 3.1 | 25.0 | 45.0 | 8.2 | | 0.8 | 0.245 |
| TX-136-25 | TFA | 13.6 | 2.2 | 0.7 | 10.8 | 67.4 | 5.2 | 3.4 | | |
| TX-136-25 | TAG | 16.6 | 4.2 | 1.4 | 20.1 | 51.5 | 6.1 | | 1.0 | 0.286 |
| TX-197-28 | TFA | 11.5 | 1.3 | 0.4 | 7.8 | 75.3 | 3.6 | 3.4 | | |
| TX-197-28 | TAG | 17.4 | 4.5 | 1.6 | 19.5 | 50.2 | 6.9 | | 0.1 | 0.035 |
| TX-197-37 | TFA | 12.6 | 3.4 | 6.3 | 17.4 | 54.1 | 6.2 | 4.5 | | |
| TX-197-37 | TAG | 13.4 | 5.0 | 10.1 | 27.4 | 40.2 | 3.9 | | 1.9 | 0.426 |

TABLE 14

TFA and TAG levels, fatty acid composition and TTQ in sorghum leaves transformed with pOIL197 or pOIL136 (pZmUbi:DGAT; pZmUbi:Oleosin) during the mature seed setting stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-197-13 | TFA | 15.2 | 6.6 | 2.6 | 12.0 | 44.7 | 18.8 | 1.0 | | |
| TX-197-13 | TAG | 10.2 | 7.0 | 2.7 | 20.4 | 55.6 | 4.1 | | 0.1 | 0.131 |
| TX-197-22 | TFA | 16.0 | 4.3 | 2.3 | 8.5 | 54.6 | 14.3 | 1.0 | | |
| TX-197-22 | TAG | 13.8 | 7.6 | 3.5 | 12.7 | 59.7 | 2.7 | | 0.2 | 0.153 |
| TX-197-19 | TFA | 13.6 | 5.3 | 1.1 | 12.4 | 56.4 | 11.2 | 1.1 | | |
| TX-197-19 | TAG | 10.8 | 8.3 | 1.6 | 18.6 | 55.2 | 5.5 | | 0.2 | 0.209 |
| TX-197-18 | TFA | 14.2 | 4.9 | 2.6 | 11.2 | 52.9 | 14.1 | 1.1 | | |
| TX-197-18 | TAG | 10.6 | 7.8 | 2.9 | 18.9 | 56.2 | 3.5 | | 0.2 | 0.148 |
| TX-136-24 | TFA | 15.1 | 4.6 | 1.5 | 12.7 | 57.6 | 8.5 | 1.2 | | |
| TX-136-24 | TAG | 11.3 | 5.2 | 2.1 | 18.9 | 56.5 | 6.1 | | 0.2 | 0.191 |
| TX-197-15 | TFA | 13.2 | 6.5 | 1.1 | 14.4 | 57.6 | 7.3 | 1.3 | | |
| TX-197-15 | TAG | 9.2 | 8.2 | 1.7 | 21.1 | 54.0 | 5.8 | | 0.3 | 0.239 |
| TX-197-10 | TFA | 12.8 | 7.6 | 1.6 | 15.2 | 50.0 | 12.8 | 1.3 | | |
| TX-197-10 | TAG | 8.9 | 7.7 | 1.9 | 22.6 | 53.9 | 5.0 | | 0.4 | 0.301 |
| TX-197-11 | TFA | 13.5 | 5.8 | 1.7 | 14.0 | 57.1 | 8.0 | 1.3 | | |
| TX-197-11 | TAG | 9.0 | 6.7 | 2.2 | 20.3 | 56.9 | 4.9 | | 0.3 | 0.242 |
| TX-197-33 | TFA | 14.8 | 4.9 | 1.8 | 12.6 | 54.9 | 10.9 | 1.3 | | |
| TX-197-33 | TAG | 12.3 | 6.2 | 2.6 | 21.3 | 51.3 | 6.3 | | 0.5 | 0.372 |
| TX-197-20 | TFA | 15.4 | 3.8 | 1.1 | 9.4 | 62.7 | 7.6 | 1.3 | | |
| TX-197-20 | TAG | 21.9 | 13.9 | 3.9 | 17.6 | 36.4 | 6.3 | | 0.1 | 0.043 |
| TX-197-21 | TFA | 14.8 | 3.6 | 1.3 | 13.0 | 61.0 | 6.3 | 1.4 | | |
| TX-197-21 | TAG | 24.9 | 14.9 | 4.5 | 22.7 | 27.3 | 5.7 | | 0.0 | 0.026 |
| TX-197-09 | TFA | 15.6 | 5.0 | 1.8 | 15.1 | 53.6 | 8.9 | 1.5 | | |
| TX-197-09 | TAG | 13.6 | 6.1 | 2.6 | 21.3 | 51.7 | 4.7 | | 0.4 | 0.277 |
| TX-197-38 | TFA | 13.9 | 4.2 | 1.4 | 12.0 | 59.7 | 8.7 | 1.6 | | |
| TX-197-38 | TAG | 12.3 | 6.4 | 2.7 | 21.6 | 49.7 | 7.4 | | 0.4 | 0.230 |
| TX-197-32 | TFA | 14.2 | 3.6 | 1.5 | 13.3 | 58.5 | 8.9 | 1.7 | | |
| TX-197-32 | TAG | 12.3 | 5.2 | 2.7 | 22.1 | 50.5 | 7.3 | | 0.5 | 0.279 |
| TX-197-17 | TFA | 14.4 | 3.5 | 1.5 | 12.4 | 57.0 | 11.3 | 2.0 | | |
| TX-197-17 | TAG | 14.0 | 4.9 | 1.5 | 17.0 | 52.1 | 10.4 | | 0.7 | 0.333 |
| TX-197-40 | TFA | 13.3 | 3.5 | 1.2 | 8.6 | 63.9 | 9.5 | 2.1 | | |
| TX-197-40 | TAG | 13.5 | 7.9 | 2.2 | 16.2 | 56.0 | 4.2 | | 0.1 | 0.042 |
| TX-197-16 | TFA | 13.9 | 4.7 | 1.2 | 13.8 | 54.1 | 12.3 | 2.1 | | |
| TX-197-16 | TAG | 10.9 | 5.9 | 1.7 | 18.6 | 51.8 | 11.1 | | 0.9 | 0.444 |

TABLE 15

TFA and TAG levels, fatty acid composition and TTQ in sorghum leaves transformed with pOIL102 (pZmUbi:WRI1) during the vegetative stage of growth.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-102-1 | TFA | 17.3 | 2.4 | 3.1 | 15.6 | 55.8 | 5.9 | 1.2 | | |
| TX-102-1 | TAG | 13.5 | 2.6 | 5.6 | 28.7 | 43.5 | 6.1 | | 0.2 | 0.182 |
| TX-102-6 | TFA | 12.4 | 1.4 | 1.1 | 9.6 | 71.7 | 3.8 | 2.0 | | |
| TX-102-6 | TAG | 21.2 | 13.4 | 4.6 | 27.3 | 32.3 | 1.3 | | 0.0 | 0.015 |
| TX-102-4 | TFA | 11.2 | 1.0 | 0.7 | 7.7 | 76.4 | 3.0 | 2.2 | | |
| TX-102-4 | TAG | 11.3 | 3.3 | 2.0 | 23.7 | 59.6 | 0.0 | | 0.0 | 0.019 |
| TX-102-8 | TFA | 10.2 | 1.2 | 0.5 | 7.2 | 77.9 | 3.0 | 2.3 | | |
| TX-102-8 | TAG | 11.6 | 3.4 | 0.0 | 23.2 | 61.8 | 0.0 | | 0.0 | 0.013 |
| TX-102-5 | TFA | 11.1 | 1.6 | 0.9 | 8.8 | 74.3 | 3.3 | 2.4 | | |
| TX-102-5 | TAG | 17.1 | 12.2 | 0.0 | 27.5 | 43.2 | 0.0 | | 0.0 | 0.015 |
| TX-102-2 | TFA | 11.4 | 1.5 | 1.0 | 9.4 | 73.5 | 3.2 | 2.4 | | |
| TX-102-2 | TAG | 13.7 | 2.9 | 3.6 | 31.2 | 48.6 | 0.0 | | 0.0 | 0.018 |
| TX-102-3 | TFA | 11.8 | 1.5 | 1.0 | 8.8 | 73.3 | 3.7 | 2.6 | | |
| TX-102-3 | TAG | 17.1 | 3.7 | 4.4 | 29.9 | 44.0 | 0.9 | | 0.0 | 0.016 |
| TX-102-7 | TFA | 12.1 | 1.4 | 1.0 | 9.3 | 72.4 | 3.8 | 2.6 | | |
| TX-102-7 | TAG | 20.9 | 15.0 | 4.8 | 26.4 | 31.6 | 1.3 | | 0.0 | 0.013 |

TABLE 16

TFA and TAG levels, fatty acid composition and TTQ in sorghum leaves transformed with pOIL102 (pZmUbi:WRI1) during the boot leaf stage of growth.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-102-8 | TFA | 16.9 | 4.2 | 2.3 | 12.3 | 57.7 | 6.5 | 0.9 | | |
| TX-102-8 | TAG | 14.5 | 6.2 | 13.5 | 25.7 | 36.8 | 3.4 | | 0.2 | 0.243 |
| TX-102-4 | TFA | 17.1 | 4.2 | 2.0 | 12.5 | 57.5 | 6.7 | 0.9 | | |
| TX-102-4 | TAG | 10.5 | 4.4 | 3.0 | 20.0 | 59.6 | 2.6 | | 0.2 | 0.182 |
| TX-102-1 | TFA | 16.6 | 4.3 | 3.9 | 15.4 | 50.7 | 9.1 | 1.1 | | |
| TX-102-1 | TAG | 10.7 | 4.4 | 5.3 | 21.9 | 54.1 | 3.6 | | 0.3 | 0.273 |
| TX-102-5 | TFA | 16.7 | 4.1 | 1.7 | 11.6 | 60.2 | 5.8 | 1.1 | | |
| TX-102-5 | TAG | 11.7 | 5.5 | 2.8 | 21.4 | 56.1 | 2.5 | | 0.1 | 0.118 |
| TX-102-6 | TFA | 17.8 | 3.8 | 15.9 | 17.0 | 38.8 | 6.6 | 1.5 | | |
| TX-102-6 | TAG | 19.6 | 7.0 | 29.4 | 25.4 | 13.9 | 4.7 | | 0.4 | 0.267 |
| TX-102-2 | TFA | 15.0 | 1.9 | 1.7 | 19.1 | 56.5 | 5.9 | 1.7 | | |
| TX-102-2 | TAG | 10.6 | 1.9 | 2.7 | 30.2 | 51.2 | 3.4 | | 0.4 | 0.258 |
| TX-102-7 | TFA | 15.0 | 3.1 | 7.0 | 13.9 | 56.1 | 4.9 | 2.4 | | |
| TX-102-7 | TAG | 16.1 | 6.5 | 20.5 | 28.0 | 24.4 | 4.5 | | 0.3 | 0.111 |
| TX-102-3 | TFA | 14.4 | 3.5 | 9.5 | 13.4 | 50.9 | 8.2 | 2.5 | | |
| TX-102-3 | TAG | 16.9 | 6.7 | 23.9 | 24.7 | 22.5 | 5.2 | | 0.4 | 0.150 |

TABLE 17

TFA and TAG levels, fatty acid composition and TTQ in sorghum leaves transformed with pOIL102 (pZmUbi:WRI1) during the mature seed setting stage of growth.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-102-5 | TFA | 17.0 | 5.2 | 1.8 | 11.2 | 53.2 | 11.5 | 1.0 | | |
| TX-102-5 | TAG | 15.7 | 7.6 | 3.5 | 19.8 | 49.7 | 3.8 | | 0.1 | 0.090 |
| TX-102-8 | TFA | 17.1 | 5.0 | 2.6 | 12.5 | 50.0 | 12.8 | 1.0 | | |
| TX-102-8 | TAG | 18.0 | 9.4 | 4.6 | 21.5 | 41.5 | 4.9 | | 0.1 | 0.096 |
| TX-102-1 | TFA | 17.2 | 5.2 | 2.6 | 17.7 | 45.5 | 11.9 | 1.0 | | |
| TX-102-1 | TAG | 13.3 | 6.8 | 4.0 | 26.5 | 43.8 | 5.6 | | 0.2 | 0.203 |
| TX-102-9 | TFA | 15.9 | 5.1 | 1.6 | 12.9 | 53.8 | 10.8 | 1.1 | | |
| TX-102-9 | TAG | 14.0 | 7.2 | 3.2 | 24.1 | 48.3 | 3.2 | | 0.1 | 0.089 |
| TX-102-4 | TFA | 17.4 | 5.3 | 3.1 | 12.0 | 48.4 | 13.7 | 1.1 | | |
| TX-102-4 | TAG | 15.4 | 6.2 | 4.1 | 22.0 | 48.1 | 4.2 | | 0.1 | 0.092 |
| TX-102-6 | TFA | 18.2 | 4.7 | 6.3 | 18.6 | 40.9 | 11.3 | 1.5 | | |
| TX-102-6 | TAG | 18.4 | 7.6 | 14.5 | 31.7 | 21.0 | 6.8 | | 0.2 | 0.147 |
| TX-102-2 | TFA | 14.4 | 6.8 | 29.7 | 18.8 | 18.8 | 11.4 | 2.0 | | |
| TX-102-2 | TAG | 12.3 | 9.1 | 40.3 | 21.8 | 7.4 | 9.0 | | 0.9 | 0.456 |

TABLE 18

TFA and TAG levels, fatty acid composition and TTQ in sorghum leaves transformed with pOIL102 (pZmUbi:WRI1) and pOIL197 (pZmUbi:DGAT and pZmUbi:Oleosin) during the vegetative stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-02-28 | TFA | 12.0 | 2.4 | 0.6 | 9.5 | 71.2 | 4.4 | 2.2 | | |
| TX-02-28 | TAG | 11.6 | 5.0 | 1.4 | 16.1 | 61.1 | 4.8 | | 0.2 | 0.081 |
| TX-02-18 | TFA | 12.9 | 2.3 | 0.8 | 10.0 | 69.6 | 4.4 | 2.2 | | |
| TX-02-18 | TAG | 11.1 | 4.9 | 1.9 | 21.7 | 58.2 | 2.2 | | 0.1 | 0.059 |
| TX-02-37 | TFA | 8.7 | 1.2 | 0.4 | 7.0 | 79.1 | 3.7 | 2.3 | | |
| TX-02-37 | TAG | 18.3 | 6.5 | 0.0 | 24.0 | 45.7 | 5.5 | | 0.0 | 0.013 |
| TX-02-29 | TFA | 12.0 | 2.6 | 0.5 | 7.5 | 72.3 | 5.1 | 2.4 | | |
| TX-02-29 | TAG | 10.0 | 3.8 | 1.3 | 14.5 | 66.1 | 4.3 | | 0.1 | 0.041 |
| TX-02-126 | TFA | 13.2 | 1.5 | 0.6 | 10.0 | 70.5 | 4.1 | 2.6 | | |
| TX-02-126 | TAG | 17.4 | 3.3 | 1.6 | 22.3 | 49.8 | 5.6 | | 0.2 | 0.085 |
| TX-02-23 | TFA | 11.0 | 2.9 | 0.4 | 5.9 | 73.1 | 6.8 | 2.6 | | |
| TX-02-23 | TAG | 11.1 | 3.9 | 1.6 | 12.9 | 66.7 | 3.9 | | 0.1 | 0.048 |
| TX-02-38 | TFA | 19.6 | 2.0 | 3.1 | 20.5 | 47.8 | 6.9 | 2.7 | | |
| TX-02-38 | TAG | 28.4 | 3.4 | 5.8 | 31.7 | 21.5 | 9.3 | | 2.2 | 0.832 |

TABLE 18-continued

TFA and TAG levels, fatty acid composition and TTQ in sorghum leaves transformed with pOIL102 (pZmUbi:WRI1) and pOIL197 (pZmUbi:DGAT and pZmUbi:Oleosin) during the vegetative stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-02-24 | TFA | 10.9 | 2.5 | 0.4 | 6.3 | 74.5 | 5.3 | 2.8 | | |
| TX-02-24 | TAG | 16.1 | 5.2 | 2.4 | 11.6 | 58.3 | 6.4 | | 0.1 | 0.033 |
| TX-02-25 | TFA | 10.9 | 2.1 | 0.6 | 8.9 | 72.2 | 5.3 | 2.9 | | |
| TX-02-25 | TAG | 9.5 | 4.3 | 1.5 | 15.7 | 61.7 | 7.3 | | 0.3 | 0.099 |
| TX-02-31 | TFA | 9.3 | 1.2 | 0.6 | 8.7 | 76.4 | 3.7 | 3.1 | | |
| TX-02-31 | TAG | 24.5 | 7.2 | 4.5 | 33.7 | 30.2 | 0.0 | | 0.0 | 0.007 |
| TX-02-129 | TFA | 11.3 | 1.4 | 0.6 | 9.0 | 74.0 | 3.8 | 3.2 | | |
| TX-02-129 | TAG | 18.7 | 5.0 | 2.2 | 28.1 | 38.7 | 7.2 | | 0.1 | 0.026 |
| TX-02-34 | TFA | 10.1 | 1.3 | 0.8 | 10.2 | 73.4 | 4.2 | 3.3 | | |
| TX-02-34 | TAG | 14.0 | 3.4 | 2.5 | 28.2 | 46.3 | 5.6 | | 0.3 | 0.098 |
| TX-02-127 | TFA | 11.3 | 1.6 | 0.4 | 6.6 | 77.3 | 2.7 | 3.4 | | |
| TX-02-127 | TAG | 14.6 | 5.6 | 1.9 | 16.6 | 52.9 | 8.5 | | 0.0 | 0.012 |
| TX-02-09 | TFA | 11.9 | 2.1 | 0.6 | 8.7 | 73.5 | 3.3 | 3.5 | | |
| TX-02-09 | TAG | 12.4 | 5.0 | 1.8 | 21.9 | 56.0 | 3.0 | | 0.1 | 0.024 |
| TX-02-131 | TFA | 11.0 | 1.4 | 0.3 | 8.1 | 75.9 | 3.2 | 3.5 | | |
| TX-02-131 | TAG | 16.9 | 4.9 | 1.1 | 21.3 | 48.8 | 6.9 | | 0.1 | 0.023 |
| TX-02-33 | TFA | 8.6 | 1.1 | 0.5 | 8.4 | 78.1 | 3.4 | 3.5 | | |
| TX-02-33 | TAG | 19.9 | 5.9 | 3.0 | 28.7 | 34.9 | 7.5 | | 0.0 | 0.010 |
| TX-02-36 | TFA | 9.5 | 1.3 | 0.8 | 11.0 | 73.5 | 4.0 | 3.6 | | |
| TX-02-36 | TAG | 13.7 | 3.8 | 2.6 | 33.7 | 41.7 | 4.6 | | 0.3 | 0.071 |
| TX-02-35 | TFA | 9.2 | 1.3 | 0.4 | 6.8 | 77.9 | 4.3 | 3.6 | | |
| TX-02-35 | TAG | 21.6 | 7.7 | 2.0 | 20.5 | 39.3 | 9.0 | | 0.0 | 0.012 |
| TX-02-10 | TFA | 12.3 | 2.0 | 3.4 | 20.8 | 56.6 | 4.7 | 4.0 | | |
| TX-02-10 | TAG | 18.5 | 4.0 | 7.8 | 38.5 | 23.6 | 7.5 | | 1.0 | 0.250 |
| TX-02-30 | TFA | 14.9 | 3.8 | 1.9 | 14.3 | 59.0 | 6.1 | 4.1 | | |
| TX-02-30 | TAG | 18.6 | 7.6 | 4.1 | 24.8 | 33.7 | 11.2 | | 0.9 | 0.223 |
| TX-02-12 | TFA | 13.7 | 1.6 | 0.8 | 10.1 | 69.0 | 4.7 | 4.5 | | |
| TX-02-12 | TAG | 10.5 | 4.2 | 1.7 | 26.2 | 55.5 | 1.9 | | 0.1 | 0.024 |
| TX-02-08 | TFA | 16.6 | 2.2 | 1.9 | 11.0 | 63.9 | 4.5 | 4.5 | | |
| TX-02-08 | TAG | 22.6 | 5.6 | 6.4 | 24.2 | 34.2 | 7.0 | | 0.2 | 0.039 |
| TX-02-27 | TFA | 10.9 | 1.2 | 0.5 | 8.9 | 75.8 | 2.7 | 4.6 | | |
| TX-02-27 | TAG | 19.0 | 6.0 | 2.7 | 27.8 | 39.2 | 5.3 | | 0.0 | 0.011 |
| TX-02-13 | TFA | 14.6 | 1.5 | 1.1 | 12.9 | 65.4 | 4.4 | 4.6 | | |
| TX-02-13 | TAG | 11.9 | 5.1 | 3.8 | 34.0 | 39.5 | 5.7 | | 0.3 | 0.062 |
| TX-02-05 | TFA | 14.3 | 1.4 | 0.9 | 12.1 | 66.6 | 4.7 | 5.2 | | |
| TX-02-05 | TAG | 10.4 | 3.0 | 4.0 | 42.7 | 35.8 | 4.1 | | 0.2 | 0.031 |
| TX-02-21 | TFA | 13.8 | 1.0 | 0.6 | 10.9 | 67.9 | 5.7 | 5.3 | | |
| TX-02-21 | TAG | 9.0 | 3.2 | 1.2 | 23.1 | 59.3 | 4.2 | | 0.6 | 0.121 |
| TX-02-07 | TFA | 15.6 | 1.7 | 0.6 | 8.6 | 68.9 | 4.6 | 5.5 | | |
| TX-02-07 | TAG | 21.8 | 6.4 | 3.6 | 24.6 | 34.8 | 8.8 | | 0.1 | 0.019 |
| TX-02-11 | TFA | 21.0 | 1.9 | 0.6 | 8.9 | 62.3 | 5.2 | 5.6 | | |
| TX-02-11 | TAG | 28.4 | 10.5 | 3.8 | 22.8 | 27.1 | 7.4 | | 0.2 | 0.027 |
| TX-02-14 | TFA | 15.4 | 2.4 | 1.8 | 11.5 | 64.6 | 4.2 | 5.7 | | |
| TX-02-14 | TAG | 17.0 | 6.0 | 6.1 | 32.1 | 32.6 | 6.1 | | 0.2 | 0.029 |
| TX-02-16 | TFA | 19.8 | 1.6 | 4.2 | 25.8 | 43.5 | 5.0 | 5.7 | | |
| TX-02-16 | TAG | 25.7 | 2.5 | 7.5 | 38.8 | 18.6 | 6.9 | | 2.7 | 0.481 |
| TX-02-01 | TFA | 13.9 | 1.4 | 0.6 | 10.5 | 69.1 | 4.6 | 5.8 | | |
| TX-02-01 | TAG | 9.4 | 3.3 | 2.4 | 29.9 | 51.9 | 3.1 | | 0.1 | 0.012 |
| TX-02-02 | TFA | 15.2 | 1.8 | 0.8 | 10.5 | 67.3 | 4.4 | 5.8 | | |
| TX-02-02 | TAG | 12.7 | 3.7 | 3.3 | 35.6 | 39.1 | 5.6 | | 0.2 | 0.036 |
| TX-02-06 | TFA | 17.7 | 1.5 | 0.7 | 9.4 | 66.3 | 4.2 | 6.1 | | |
| TX-02-06 | TAG | 25.6 | 3.9 | 3.0 | 23.9 | 35.2 | 8.4 | | 0.2 | 0.033 |
| TX-02-04 | TFA | 12.8 | 1.3 | 1.0 | 11.8 | 68.7 | 4.5 | 6.3 | | |
| TX-02-04 | TAG | 17.9 | 4.0 | 3.7 | 32.7 | 35.9 | 5.8 | | 0.1 | 0.013 |
| TX-02-19 | TFA | 11.9 | 1.8 | 1.5 | 15.6 | 64.5 | 4.7 | 7.2 | | |
| TX-02-19 | TAG | 10.9 | 3.9 | 5.2 | 41.9 | 30.6 | 7.5 | | 0.7 | 0.097 |

TABLE 19

TFA and TAG levels, fatty acid composition and TTQ in sorghum leaves transformed with pOIL102 (pZmUbi:WRI1) and pOIL197 (pZmUbi:DGAT and pZmUbi:Oleosin) during the boot leaf stage of growth. The lines are listed in order of increasing TFA levels.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-02-27 | TFA | 17.3 | 3.8 | 1.4 | 10.1 | 60.1 | 7.2 | 1.0 | | |
| TX-02-27 | TAG | 11.9 | 4.4 | 2.1 | 19.4 | 61.2 | 0.8 | | 0.2 | 0.164 |
| TX-02-21 | TFA | 15.9 | 2.3 | 2.0 | 19.3 | 53.3 | 7.3 | 1.2 | | |
| TX-02-21 | TAG | 12.6 | 3.7 | 2.7 | 27.0 | 51.0 | 3.0 | | 0.4 | 0.318 |
| TX-02-01 | TFA | 15.2 | 4.2 | 5.1 | 14.7 | 53.2 | 7.5 | 1.3 | | |
| TX-02-01 | TAG | 11.7 | 5.6 | 9.3 | 26.1 | 42.9 | 4.5 | | 0.3 | 0.199 |
| TX-02-12 | TFA | 15.3 | 3.2 | 2.0 | 13.6 | 58.9 | 6.9 | 1.3 | | |
| TX-02-12 | TAG | 13.7 | 4.2 | 3.6 | 25.1 | 50.4 | 2.9 | | 0.1 | 0.111 |
| TX-02-33 | TFA | 15.9 | 4.3 | 1.0 | 10.1 | 59.7 | 9.1 | 1.4 | | |
| TX-02-33 | TAG | 14.3 | 5.4 | 2.7 | 18.9 | 54.7 | 4.0 | | 0.1 | 0.107 |
| TX-02-13 | TFA | 15.4 | 5.1 | 11.4 | 19.4 | 39.1 | 9.5 | 1.4 | | |
| TX-02-13 | TAG | 12.9 | 6.5 | 20.3 | 25.2 | 28.6 | 6.4 | | 0.5 | 0.389 |
| TX-02-36 | TFA | 16.2 | 3.4 | 1.8 | 12.3 | 58.5 | 7.8 | 1.4 | | |
| TX-02-36 | TAG | 15.4 | 5.8 | 3.3 | 21.5 | 48.9 | 5.1 | | 0.3 | 0.209 |
| TX-02-37 | TFA | 13.3 | 3.5 | 1.3 | 9.9 | 65.3 | 6.7 | 1.4 | | |
| TX-02-37 | TAG | 9.6 | 3.6 | 3.8 | 20.4 | 60.6 | 2.1 | | 0.2 | 0.137 |
| TX-02-18 | TFA | 14.6 | 3.0 | 1.4 | 9.8 | 65.5 | 5.7 | 1.4 | | |
| TX-02-18 | TAG | 12.5 | 5.6 | 4.3 | 20.6 | 54.8 | 2.3 | | 0.1 | 0.077 |
| TX-02-34 | TFA | 16.6 | 2.2 | 2.2 | 17.6 | 54.7 | 6.7 | 1.4 | | |
| TX-02-34 | TAG | 14.1 | 2.8 | 4.1 | 30.3 | 44.7 | 4.1 | | 0.3 | 0.231 |
| TX-02-31 | TFA | 13.3 | 3.1 | 1.8 | 10.1 | 64.7 | 7.0 | 1.5 | | |
| TX-02-31 | TAG | 5.4 | 1.8 | 3.2 | 17.8 | 71.1 | 0.7 | | 0.3 | 0.171 |
| TX-02-29 | TFA | 13.2 | 3.2 | 1.1 | 8.2 | 68.6 | 5.6 | 1.6 | | |
| TX-02-29 | TAG | 10.5 | 4.7 | 2.9 | 18.1 | 62.0 | 1.8 | | 0.1 | 0.082 |
| TX-02-35 | TFA | 17.8 | 3.4 | 6.5 | 14.0 | 50.3 | 8.0 | 1.6 | | |
| TX-02-35 | TAG | 18.8 | 5.3 | 19.1 | 28.4 | 22.4 | 6.1 | | 0.2 | 0.108 |
| TX-02-09 | TFA | 14.0 | 3.3 | 0.9 | 9.9 | 66.0 | 6.0 | 1.6 | | |
| TX-02-09 | TAG | 11.2 | 4.7 | 1.9 | 19.6 | 58.7 | 3.9 | | 0.1 | 0.036 |
| TX-02-24 | TFA | 12.9 | 3.5 | 0.6 | 7.9 | 67.3 | 7.7 | 1.8 | | |
| TX-02-24 | TAG | 10.7 | 3.5 | 1.6 | 11.8 | 69.0 | 3.4 | | 0.1 | 0.044 |
| TX-02-126 | TFA | 13.8 | 2.7 | 1.1 | 9.9 | 66.4 | 6.0 | 1.8 | | |
| TX-02-126 | TAG | 12.8 | 4.3 | 2.1 | 17.0 | 58.6 | 5.2 | | 0.5 | 0.247 |
| TX-02-23 | TFA | 13.6 | 2.7 | 0.7 | 8.9 | 68.3 | 5.8 | 1.9 | | |
| TX-02-23 | TAG | 10.0 | 3.3 | 2.2 | 18.2 | 63.9 | 2.4 | | 0.1 | 0.047 |
| TX-02-07 | TFA | 17.5 | 2.3 | 10.9 | 17.5 | 44.5 | 7.3 | 1.9 | | |
| TX-02-07 | TAG | 21.0 | 3.9 | 24.5 | 27.4 | 15.2 | 8.0 | | 0.4 | 0.225 |
| TX-02-28 | TFA | 12.8 | 2.9 | 0.5 | 7.7 | 68.4 | 7.8 | 2.0 | | |
| TX-02-28 | TAG | 13.0 | 5.5 | 1.2 | 11.1 | 64.3 | 4.8 | | 0.1 | 0.063 |
| TX-02-04 | TFA | 13.6 | 2.9 | 1.2 | 12.1 | 65.3 | 4.9 | 2.1 | | |
| TX-02-04 | TAG | 12.0 | 4.4 | 2.4 | 21.6 | 55.9 | 3.6 | | 0.4 | 0.206 |
| TX-02-25 | TFA | 12.2 | 2.8 | 0.5 | 9.4 | 68.8 | 6.3 | 2.5 | | |
| TX-02-25 | TAG | 10.3 | 4.2 | 1.0 | 15.4 | 62.5 | 6.6 | | 0.4 | 0.159 |
| TX-02-05 | TFA | 13.6 | 3.6 | 3.2 | 14.7 | 59.8 | 5.1 | 2.5 | | |
| TX-02-05 | TAG | 12.2 | 5.5 | 7.0 | 26.8 | 43.4 | 5.1 | | 0.6 | 0.220 |
| TX-02-14 | TFA | 15.9 | 5.7 | 30.9 | 12.7 | 26.0 | 8.9 | 2.8 | | |
| TX-02-14 | TAG | 17.9 | 8.5 | 42.6 | 14.9 | 7.8 | 8.4 | | 1.4 | 0.514 |
| TX-02-131 | TFA | 12.6 | 1.4 | 0.6 | 8.3 | 73.1 | 3.9 | 2.9 | | |
| TX-02-131 | TAG | 16.0 | 3.9 | 1.9 | 18.0 | 53.9 | 6.3 | | 0.2 | 0.061 |
| TX-02-129 | TFA | 12.1 | 1.6 | 1.0 | 10.4 | 70.5 | 4.3 | 2.9 | | |
| TX-02-129 | TAG | 12.8 | 3.6 | 2.5 | 22.0 | 53.6 | 5.5 | | 0.3 | 0.106 |
| TX-02-08 | TFA | 17.6 | 2.6 | 5.6 | 17.2 | 51.2 | 5.8 | 3.0 | | |
| TX-02-08 | TAG | 24.4 | 5.9 | 15.8 | 29.3 | 15.8 | 8.8 | | 0.6 | 0.183 |
| TX-02-02 | TFA | 17.9 | 3.1 | 7.2 | 15.5 | 49.6 | 6.7 | 3.1 | | |
| TX-02-02 | TAG | 23.7 | 6.5 | 17.7 | 22.8 | 19.6 | 9.7 | | 0.6 | 0.194 |
| TX-02-11 | TFA | 25.1 | 4.1 | 9.0 | 16.3 | 36.3 | 9.1 | 3.2 | | |
| TX-02-11 | TAG | 33.3 | 6.6 | 13.9 | 20.9 | 16.0 | 9.3 | | 1.1 | 0.341 |
| TX-02-127 | TFA | 11.4 | 1.6 | 0.3 | 8.9 | 75.4 | 2.4 | 3.5 | | |
| TX-02-127 | TAG | 21.0 | 5.8 | 1.4 | 20.6 | 47.4 | 3.9 | | 0.1 | 0.016 |
| TX-02-30 | TFA | 16.4 | 3.1 | 3.7 | 17.1 | 53.8 | 5.9 | 4.0 | | |
| TX-02-30 | TAG | 21.3 | 5.0 | 7.6 | 27.1 | 30.5 | 8.5 | | 0.9 | 0.236 |
| TX-02-19 | TFA | 13.5 | 2.7 | 25.4 | 22.6 | 30.8 | 5.0 | 4.2 | | |
| TX-02-19 | TAG | 14.0 | 3.3 | 34.3 | 27.0 | 16.6 | 4.8 | | 2.3 | 0.548 |
| TX-02-06 | TFA | 24.0 | 4.8 | 14.3 | 19.6 | 29.7 | 7.7 | 4.8 | | |
| TX-02-06 | TAG | 29.7 | 6.9 | 19.2 | 23.0 | 13.4 | 7.7 | | 2.7 | 0.555 |
| TX-02-10 | TFA | 22.0 | 3.3 | 10.3 | 22.7 | 33.7 | 7.9 | 6.3 | | |
| TX-02-10 | TAG | 24.8 | 4.1 | 12.9 | 27.0 | 22.4 | 8.8 | | 3.5 | 0.551 |
| TX-02-38 | TFA | 24.8 | 4.4 | 13.9 | 24.5 | 23.7 | 8.7 | 6.4 | | |
| TX-02-38 | TAG | 21.5 | 5.3 | 8.6 | 25.2 | 39.3 | 0.0 | | 2.5 | 0.392 |

TABLE 20

TFA and TAG levels, fatty acid composition and TTQ in sorghum leaves transformed with pOIL102 (pZmUbi:WRI1) and pOIL197 (pZmUbi:DGAT and pZmUbi:Oleosin) during the mature seed setting stage of growth.

| Line | TAG or TFA | C16:0 | C18:0 | C18:1 | C18:2 | C18:3n3 | Other | TFA | TAG | TTQ |
|---|---|---|---|---|---|---|---|---|---|---|
| TX-02-18 | TFA | 15.6 | 5.5 | 1.1 | 13.2 | 54.3 | 10.3 | 0.8 | | |
| TX-02-18 | TAG | 14.2 | 7.7 | 2.5 | 22.7 | 49.2 | 3.7 | | 0.1 | 0.133 |
| TX-02-31 | TFA | 15.6 | 4.4 | 1.6 | 11.1 | 55.9 | 11.4 | 0.9 | | |
| TX-02-31 | TAG | 12.3 | 6.3 | 3.2 | 19.8 | 56.2 | 2.2 | | 0.2 | 0.163 |
| TX-02-37 | TFA | 14.8 | 4.7 | 1.8 | 10.3 | 57.5 | 10.8 | 1.0 | | |
| TX-02-37 | TAG | 9.6 | 5.8 | 3.2 | 20.6 | 58.6 | 2.1 | | 0.1 | 0.147 |
| TX-02-12 | TFA | 16.4 | 3.8 | 1.7 | 13.0 | 54.8 | 10.2 | 1.0 | | |
| TX-02-12 | TAG | 15.1 | 6.2 | 3.3 | 21.0 | 50.0 | 4.4 | | 0.3 | 0.258 |
| TX-02-29 | TFA | 14.9 | 4.7 | 1.1 | 9.8 | 60.0 | 9.5 | 1.1 | | |
| TX-02-29 | TAG | 14.4 | 12.7 | 2.4 | 17.5 | 50.6 | 2.4 | | 0.1 | 0.125 |
| TX-02-01 | TFA | 14.9 | 4.6 | 1.4 | 10.5 | 59.0 | 9.5 | 1.3 | | |
| TX-02-01 | TAG | 15.8 | 6.4 | 3.1 | 17.3 | 54.3 | 3.1 | | 0.1 | 0.083 |
| TX-02-23 | TFA | 14.3 | 4.6 | 1.4 | 8.2 | 63.5 | 8.0 | 1.3 | | |
| TX-02-23 | TAG | 9.9 | 6.1 | 2.6 | 13.2 | 48.5 | 19.8 | | 0.1 | 0.104 |
| TX-02-09 | TFA | 14.1 | 4.5 | 0.9 | 8.4 | 65.0 | 7.0 | 1.4 | | |
| TX-02-09 | TAG | 16.4 | 11.7 | 2.4 | 14.0 | 51.6 | 3.8 | | 0.1 | 0.052 |
| TX-02-24 | TFA | 15.1 | 4.3 | 0.9 | 11.6 | 59.3 | 8.8 | 1.5 | | |
| TX-02-24 | TAG | 14.5 | 7.4 | 2.3 | 23.8 | 48.0 | 4.1 | | 0.1 | 0.094 |
| TX-02-28 | TFA | 14.3 | 3.5 | 0.7 | 8.6 | 65.9 | 7.0 | 1.5 | | |
| TX-02-28 | TAG | 16.3 | 13.2 | 1.9 | 12.4 | 52.0 | 4.2 | | 0.1 | 0.074 |
| TX-02-34 | TFA | 15.2 | 3.8 | 1.4 | 15.3 | 54.2 | 10.1 | 1.5 | | |
| TX-02-34 | TAG | 13.3 | 5.8 | 2.2 | 22.3 | 47.0 | 9.5 | | 0.5 | 0.347 |
| TX-02-27 | TFA | 14.8 | 2.8 | 0.9 | 8.9 | 67.5 | 5.1 | 1.5 | | |
| TX-02-27 | TAG | 15.9 | 11.9 | 3.5 | 20.2 | 46.5 | 1.9 | | 0.1 | 0.049 |
| TX-02-33 | TFA | 14.6 | 4.1 | 2.4 | 13.3 | 57.2 | 8.4 | 1.5 | | |
| TX-02-33 | TAG | 12.5 | 7.3 | 4.1 | 21.9 | 49.1 | 5.2 | | 0.3 | 0.200 |
| TX-02-07 | TFA | 12.3 | 4.2 | 0.8 | 8.4 | 69.9 | 4.4 | 1.5 | | |
| TX-02-07 | TAG | 10.6 | 5.5 | 2.3 | 17.8 | 60.8 | 2.9 | | 0.1 | 0.042 |
| TX-02-05 | TFA | 15.4 | 6.5 | 7.0 | 21.7 | 39.3 | 10.2 | 1.6 | | |
| TX-02-05 | TAG | 13.1 | 8.3 | 11.4 | 30.1 | 28.9 | 8.3 | | 0.6 | 0.376 |
| TX-02-08 | TFA | 18.4 | 2.8 | 2.5 | 14.4 | 52.5 | 9.5 | 1.9 | | |
| TX-02-08 | TAG | 25.0 | 6.2 | 7.6 | 23.7 | 27.3 | 10.2 | | 0.2 | 0.128 |
| TX-02-127 | TFA | 12.6 | 2.8 | 0.6 | 7.5 | 71.9 | 4.5 | 2.4 | | |
| TX-02-127 | TAG | 11.9 | 5.0 | 2.1 | 14.6 | 63.4 | 2.9 | | 0.1 | 0.026 |
| TX-02-38 | TFA | 41.9 | 14.1 | 19.6 | 8.7 | 1.5 | 14.2 | 3.0 | | |
| TX-02-38 | TAG | 25.3 | 9.9 | 32.5 | 16.1 | 2.7 | 13.4 | | 1.1 | 0.365 |
| TX-02-02 | TFA | 16.5 | 6.8 | 28.2 | 15.1 | 21.2 | 12.2 | 3.5 | | |
| TX-02-02 | TAG | 16.5 | 9.8 | 39.1 | 16.5 | 7.1 | 10.9 | | 1.7 | 0.496 |
| TX-02-06 | TFA | 25.3 | 4.8 | 12.0 | 24.3 | 19.3 | 14.3 | 4.0 | | |
| TX-02-06 | TAG | 27.1 | 6.2 | 14.7 | 27.8 | 12.4 | 11.8 | | 2.6 | 0.658 |
| TX-02-30 | TFA | 17.0 | 4.1 | 6.7 | 20.2 | 43.3 | 8.7 | 4.3 | | |
| TX-02-30 | TAG | 19.6 | 5.8 | 11.4 | 27.4 | 26.1 | 9.7 | | 2.2 | 0.509 |
| TX-02-14 | TFA | 13.3 | 7.3 | 56.1 | 6.2 | 8.8 | 8.3 | 6.1 | | |
| TX-02-14 | TAG | 13.7 | 8.7 | 60.1 | 6.1 | 4.3 | 7.1 | | 4.3 | 0.706 |

TABLE 21

TFA and TAG levels, fatty acid composition and TTQ in pOIL103 + pOIL197 primary transformants at vegetative setting stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-03-07 | TFA | 22.6 | 3.3 | 1.3 | 12.7 | 51.8 | 8.4 | 2.4 | | |
| TX-03-07 | TAG | 29.4 | 5.6 | 3.3 | 20.9 | 31.3 | 9.4 | | 0.1 | 0.056 |
| TX-03-02 | TFA | 17.7 | 2.6 | 1.1 | 9.1 | 64.0 | 5.4 | 2.4 | | |
| TX-03-02 | TAG | 20.2 | 5.1 | 2.8 | 16.4 | 47.7 | 7.7 | | 0.2 | 0.079 |
| TX-03-01 | TFA | 16.9 | 2.5 | 1.2 | 8.7 | 65.7 | 4.9 | 2.8 | | |
| TX-03-01 | TAG | 18.8 | 5.4 | 3.3 | 17.3 | 47.7 | 7.5 | | 0.3 | 0.096 |
| TX-03-52 | TFA | 13.8 | 1.4 | 0.8 | 8.9 | 70.6 | 4.5 | 2.9 | | |
| TX-03-52 | TAG | 23.2 | 4.3 | 2.3 | 19.6 | 42.8 | 7.8 | | 0.2 | 0.082 |
| TX-03-47 | TFA | 14.1 | 1.6 | 0.6 | 6.5 | 73.5 | 3.7 | 3.0 | | |
| TX-03-47 | TAG | 20.6 | 3.9 | 3.8 | 18.0 | 48.6 | 5.2 | | 0.1 | 0.023 |
| TX-03-17 | TFA | 15.3 | 1.4 | 0.5 | 7.1 | 72.1 | 3.6 | 3.0 | | |
| TX-03-17 | TAG | 29.4 | 4.0 | 2.0 | 16.8 | 41.6 | 6.3 | | 0.1 | 0.039 |
| TX-03-05 | TFA | 23.2 | 2.0 | 0.6 | 8.1 | 61.2 | 4.9 | 3.0 | | |
| TX-03-05 | TAG | 43.9 | 4.4 | 1.6 | 14.4 | 28.9 | 6.8 | | 0.2 | 0.053 |
| TX-03-53 | TFA | 19.6 | 1.9 | 1.1 | 10.9 | 61.0 | 5.6 | 3.1 | | |

TABLE 21-continued

TFA and TAG levels, fatty acid composition and TTQ in pOIL103 + pOIL197 primary transformants at vegetative setting stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-03-53 | TAG | 35.3 | 3.9 | 3.1 | 20.5 | 30.7 | 6.5 | | 0.3 | 0.082 |
| TX-03-19 | TFA | 20.8 | 1.8 | 0.6 | 9.1 | 63.9 | 3.9 | 3.1 | | |
| TX-03-19 | TAG | 39.9 | 4.4 | 1.8 | 17.2 | 26.9 | 9.8 | | 0.2 | 0.056 |
| TX-03-10 | TFA | 27.8 | 4.3 | 1.1 | 21.0 | 38.0 | 7.8 | 3.1 | | |
| TX-03-10 | TAG | 35.2 | 7.3 | 1.7 | 26.3 | 19.8 | 9.7 | | 1.4 | 0.442 |
| TX-03-48 | TFA | 21.4 | 2.1 | 0.8 | 9.0 | 62.0 | 4.8 | 3.2 | | |
| TX-03-48 | TAG | 39.1 | 4.5 | 2.3 | 15.6 | 31.7 | 6.8 | | 0.2 | 0.062 |
| TX-03-61 | TFA | 16.7 | 1.3 | 1.8 | 17.6 | 57.4 | 5.3 | 3.2 | | |
| TX-03-61 | TAG | 19.0 | 4.6 | 2.9 | 33.9 | 28.9 | 10.7 | | 0.2 | 0.047 |
| TX-03-32 | TFA | 15.6 | 1.5 | 0.7 | 10.7 | 67.3 | 4.1 | 3.2 | | |
| TX-03-32 | TAG | 28.8 | 4.0 | 3.4 | 26.5 | 29.2 | 8.1 | | 0.1 | 0.032 |
| TX-03-40 | TFA | 15.0 | 1.3 | 0.6 | 9.1 | 69.8 | 4.2 | 3.3 | | |
| TX-03-40 | TAG | 27.6 | 3.7 | 2.2 | 25.2 | 32.1 | 9.2 | | 0.2 | 0.057 |
| TX-03-49 | TFA | 17.3 | 1.5 | 0.5 | 8.0 | 68.0 | 4.8 | 3.3 | | |
| TX-03-49 | TAG | 35.0 | 6.9 | 1.9 | 18.4 | 26.4 | 11.3 | | 0.1 | 0.015 |
| TX-03-21 | TFA | 13.1 | 1.3 | 0.6 | 7.8 | 73.7 | 3.5 | 3.3 | | |
| TX-03-21 | TAG | 20.3 | 4.1 | 3.3 | 23.1 | 43.0 | 6.3 | | 0.1 | 0.029 |
| TX-03-62 | TFA | 18.0 | 1.1 | 1.9 | 13.6 | 59.8 | 5.5 | 3.3 | | |
| TX-03-62 | TAG | 26.2 | 4.8 | 5.7 | 30.2 | 24.9 | 8.3 | | 0.2 | 0.051 |
| TX-03-26 | TFA | 14.0 | 1.5 | 0.5 | 7.9 | 72.3 | 3.8 | 3.4 | | |
| TX-03-26 | TAG | 22.8 | 3.8 | 3.2 | 22.8 | 40.5 | 6.9 | | 0.1 | 0.023 |
| TX-03-36 | TFA | 19.7 | 1.6 | 0.8 | 8.9 | 63.7 | 5.2 | 3.5 | | |
| TX-03-36 | TAG | 37.1 | 3.9 | 2.3 | 17.1 | 30.5 | 9.0 | | 0.3 | 0.075 |
| TX-03-50 | TFA | 16.7 | 1.3 | 0.8 | 9.3 | 66.7 | 5.2 | 3.5 | | |
| TX-03-50 | TAG | 35.9 | 3.9 | 4.0 | 21.9 | 25.2 | 9.2 | | 0.1 | 0.026 |
| TX-03-23 | TFA | 19.5 | 1.6 | 0.3 | 6.1 | 67.1 | 5.4 | 3.5 | | |
| TX-03-23 | TAG | 39.0 | 4.3 | 1.2 | 13.9 | 32.7 | 9.0 | | 0.2 | 0.044 |
| TX-03-45 | TFA | 15.0 | 1.6 | 0.3 | 6.2 | 71.9 | 5.0 | 3.5 | | |
| TX-03-45 | TAG | 27.1 | 4.7 | 0.8 | 14.1 | 41.7 | 11.6 | | 0.3 | 0.087 |
| TX-03-34 | TFA | 20.6 | 1.7 | 0.8 | 11.0 | 60.3 | 5.6 | 3.5 | | |
| TX-03-34 | TAG | 36.1 | 3.9 | 2.1 | 21.6 | 27.5 | 8.9 | | 0.2 | 0.068 |
| TX-03-51 | TFA | 12.3 | 1.3 | 0.7 | 9.3 | 72.9 | 3.6 | 3.6 | | |
| TX-03-51 | TAG | 23.8 | 4.8 | 2.6 | 26.7 | 32.2 | 9.9 | | 0.1 | 0.034 |
| TX-03-63 | TFA | 15.7 | 1.3 | 1.8 | 16.9 | 59.7 | 4.7 | 3.7 | | |
| TX-03-63 | TAG | 23.9 | 3.8 | 2.9 | 31.7 | 26.6 | 11.1 | | 0.2 | 0.049 |
| TX-03-41 | TFA | 21.0 | 1.7 | 0.6 | 8.0 | 63.7 | 4.9 | 3.7 | | |
| TX-03-41 | TAG | 44.7 | 3.8 | 1.7 | 15.2 | 27.4 | 7.1 | | 0.2 | 0.067 |
| TX-03-20 | TFA | 10.7 | 1.5 | 0.7 | 9.0 | 74.7 | 3.3 | 3.7 | | |
| TX-03-20 | TAG | 14.1 | 4.0 | 2.3 | 24.1 | 47.3 | 8.2 | | 0.2 | 0.061 |
| TX-03-29 | TFA | 20.3 | 1.9 | 0.9 | 11.0 | 61.2 | 4.7 | 3.7 | | |
| TX-03-29 | TAG | 37.1 | 4.4 | 3.1 | 21.2 | 27.5 | 6.7 | | 0.2 | 0.054 |
| TX-03-25 | TFA | 12.1 | 1.5 | 0.5 | 6.5 | 75.9 | 3.5 | 3.8 | | |
| TX-03-25 | TAG | 17.6 | 7.2 | 2.7 | 16.6 | 48.5 | 7.3 | | 0.1 | 0.030 |
| TX-03-33 | TFA | 24.1 | 2.2 | 0.9 | 13.0 | 53.2 | 6.6 | 3.8 | | |
| TX-03-33 | TAG | 40.6 | 4.3 | 1.7 | 20.9 | 23.3 | 9.1 | | 0.6 | 0.168 |
| TX-03-22 | TFA | 22.3 | 1.7 | 1.2 | 13.8 | 54.5 | 6.5 | 3.9 | | |
| TX-03-22 | TAG | 37.9 | 3.3 | 2.2 | 23.4 | 23.5 | 9.8 | | 1.0 | 0.245 |
| TX-03-46 | TFA | 24.4 | 1.7 | 0.7 | 9.9 | 57.3 | 6.0 | 4.0 | | |
| TX-03-46 | TAG | 45.2 | 3.2 | 1.4 | 17.6 | 24.6 | 8.0 | | 0.6 | 0.148 |
| TX-03-11 | TFA | 25.4 | 2.8 | 1.0 | 20.8 | 42.9 | 7.2 | 4.0 | | |
| TX-03-11 | TAG | 33.4 | 4.8 | 1.5 | 28.8 | 21.6 | 9.9 | | 1.4 | 0.337 |
| TX-03-18 | TFA | 20.8 | 2.7 | 0.9 | 13.9 | 56.2 | 5.5 | 4.1 | | |
| TX-03-18 | TAG | 33.6 | 7.1 | 2.7 | 24.8 | 21.5 | 10.3 | | 0.3 | 0.078 |
| TX-03-57 | TFA | 12.9 | 1.4 | 1.8 | 15.8 | 63.4 | 4.6 | 4.2 | | |
| TX-03-57 | TAG | 14.5 | 2.5 | 7.6 | 41.5 | 24.9 | 9.0 | | 0.5 | 0.127 |
| TX-03-58 | TFA | 13.0 | 1.5 | 1.8 | 15.7 | 63.3 | 4.8 | 4.2 | | |
| TX-03-58 | TAG | 16.4 | 3.4 | 4.9 | 35.3 | 31.2 | 8.8 | | 0.6 | 0.148 |
| TX-03-54 | TFA | 22.8 | 1.9 | 1.0 | 16.4 | 51.2 | 6.8 | 5.0 | | |
| TX-03-54 | TAG | 36.0 | 3.5 | 1.7 | 26.1 | 21.6 | 11.1 | | 1.2 | 0.245 |
| TX-03-28 | TFA | 28.3 | 2.2 | 1.0 | 16.8 | 44.1 | 7.6 | 5.4 | | |
| TX-03-28 | TAG | 40.9 | 3.3 | 1.4 | 23.4 | 22.4 | 8.6 | | 2.3 | 0.434 |
| TX-03-31 | TFA | 22.2 | 2.2 | 2.0 | 25.2 | 41.6 | 6.8 | 5.6 | | |
| TX-03-31 | TAG | 30.9 | 3.6 | 3.0 | 34.7 | 18.5 | 9.3 | | 2.3 | 0.410 |
| TX-03-04 | TFA | 24.3 | 3.4 | 0.6 | 10.5 | 55.4 | 5.8 | 7.0 | | |
| TX-03-04 | TAG | 36.1 | 6.5 | 2.2 | 15.9 | 31.3 | 8.0 | | 0.1 | 0.016 |
| TX-03-08 | TFA | 22.6 | 1.9 | 0.6 | 6.8 | 63.8 | 4.3 | 8.3 | | |
| TX-03-08 | TAG | 46.4 | 4.6 | 4.2 | 11.1 | 26.7 | 7.0 | | 0.1 | 0.017 |

TABLE 22

TFA and TAG levels, fatty acid composition and TTQ in pOIL103 + pOIL197 primary transformants at boot leaf stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-03-20 | TFA | 12.2 | 2.6 | 1.7 | 10.3 | 67.5 | 5.7 | 2.1 | | |
| TX-03-20 | TAG | 9.4 | 3.6 | 3.3 | 18.1 | 63.0 | 2.5 | | 0.4 | 0.217 |
| TX-03-54 | TFA | 13.6 | 3.5 | 3.0 | 12.1 | 61.5 | 6.4 | 2.1 | | |
| TX-03-54 | TAG | 14.1 | 6.9 | 7.0 | 22.5 | 43.5 | 6.0 | | 0.4 | 0.207 |
| TX-03-61 | TFA | 23.9 | 3.1 | 1.7 | 19.0 | 43.9 | 8.3 | 2.2 | | |
| TX-03-61 | TAG | 31.4 | 6.6 | 3.4 | 28.3 | 19.6 | 10.8 | | 0.4 | 0.159 |
| TX-03-02 | TFA | 14.9 | 3.0 | 2.8 | 12.1 | 60.6 | 6.6 | 2.2 | | |
| TX-03-02 | TAG | 14.8 | 5.5 | 5.6 | 20.6 | 46.7 | 6.8 | | 0.5 | 0.222 |
| TX-03-53 | TFA | 18.5 | 3.7 | 8.9 | 15.4 | 43.1 | 10.4 | 2.3 | | |
| TX-03-53 | TAG | 20.1 | 6.8 | 16.7 | 24.5 | 23.3 | 8.6 | | 0.6 | 0.275 |
| TX-03-01 | TFA | 13.4 | 3.0 | 3.0 | 12.5 | 61.8 | 6.4 | 2.3 | | |
| TX-03-01 | TAG | 13.9 | 5.5 | 7.5 | 23.0 | 42.6 | 7.4 | | 0.4 | 0.164 |
| TX-03-47 | TFA | 12.8 | 2.1 | 1.6 | 7.5 | 70.7 | 5.3 | 2.4 | | |
| TX-03-47 | TAG | 14.8 | 5.1 | 5.0 | 19.3 | 52.1 | 3.7 | | 0.1 | 0.050 |
| TX-03-07 | TFA | 18.4 | 2.8 | 7.6 | 15.6 | 47.1 | 8.5 | 2.5 | | |
| TX-03-07 | TAG | 25.8 | 6.4 | 18.7 | 25.5 | 15.2 | 8.5 | | 0.3 | 0.127 |
| TX-03-05 | TFA | 21.4 | 2.3 | 1.4 | 9.7 | 59.1 | 6.1 | 2.6 | | |
| TX-03-05 | TAG | 36.4 | 5.6 | 3.9 | 17.1 | 28.4 | 8.6 | | 0.4 | 0.168 |
| TX-03-49 | TFA | 18.1 | 3.7 | 8.2 | 13.2 | 52.0 | 4.9 | 2.6 | | |
| TX-03-49 | TAG | 24.1 | 8.2 | 18.3 | 20.9 | 18.8 | 9.7 | | 0.5 | 0.212 |
| TX-03-34 | TFA | 19.0 | 2.7 | 6.0 | 15.4 | 50.6 | 6.4 | 2.6 | | |
| TX-03-34 | TAG | 24.8 | 10.5 | 10.9 | 23.9 | 20.6 | 9.3 | | 0.8 | 0.287 |
| TX-03-32 | TFA | 18.2 | 2.2 | 1.6 | 12.4 | 60.2 | 5.4 | 2.8 | | |
| TX-03-32 | TAG | 20.8 | 14.6 | 3.2 | 21.4 | 31.5 | 8.5 | | 0.6 | 0.204 |
| TX-03-04 | TFA | 18.8 | 3.1 | 5.8 | 13.4 | 50.3 | 8.6 | 2.9 | | |
| TX-03-04 | TAG | 26.7 | 7.5 | 14.6 | 23.1 | 19.0 | 9.1 | | 0.3 | 0.118 |
| TX-03-23 | TFA | 18.9 | 1.7 | 1.0 | 7.9 | 63.2 | 7.3 | 2.9 | | |
| TX-03-23 | TAG | 25.0 | 4.6 | 2.5 | 18.1 | 39.6 | 10.2 | | 0.2 | 0.070 |
| TX-03-25 | TFA | 14.5 | 1.8 | 0.4 | 6.4 | 73.5 | 3.4 | 3.0 | | |
| TX-03-25 | TAG | 20.3 | 5.1 | 1.0 | 12.3 | 53.6 | 7.7 | | 0.3 | 0.110 |
| TX-03-18 | TFA | 21.1 | 2.9 | 1.2 | 17.8 | 46.3 | 10.7 | 3.0 | | |
| TX-03-18 | TAG | 22.6 | 5.9 | 4.5 | 31.1 | 22.6 | 13.3 | | 0.4 | 0.143 |
| TX-03-50 | TFA | 16.5 | 2.6 | 6.1 | 12.9 | 53.9 | 8.0 | 3.0 | | |
| TX-03-50 | TAG | 20.2 | 19.9 | 12.9 | 19.6 | 20.6 | 6.8 | | 0.7 | 0.217 |
| TX-03-60 | TFA | 20.2 | 2.9 | 0.8 | 14.1 | 55.7 | 6.2 | 3.1 | | |
| TX-03-60 | TAG | 30.5 | 6.2 | 1.6 | 21.6 | 30.2 | 9.9 | | 0.6 | 0.202 |
| TX-03-21 | TFA | 12.3 | 1.7 | 0.5 | 6.8 | 74.4 | 4.4 | 3.2 | | |
| TX-03-21 | TAG | 16.1 | 4.7 | 1.6 | 13.1 | 57.0 | 7.5 | | 0.2 | 0.067 |
| TX-03-40 | TFA | 17.1 | 1.4 | 0.4 | 8.0 | 68.2 | 4.9 | 3.2 | | |
| TX-03-40 | TAG | 34.5 | 4.4 | 0.9 | 14.5 | 39.8 | 5.9 | | 0.4 | 0.112 |
| TX-03-62 | TFA | 25.3 | 2.9 | 1.7 | 14.7 | 47.9 | 7.6 | 3.3 | | |
| TX-03-62 | TAG | 40.3 | 5.6 | 3.5 | 22.3 | 18.7 | 9.5 | | 0.6 | 0.171 |
| TX-03-36 | TFA | 19.5 | 2.0 | 2.0 | 11.4 | 58.3 | 6.8 | 3.5 | | |
| TX-03-36 | TAG | 31.2 | 4.0 | 4.4 | 20.0 | 29.4 | 11.0 | | 0.6 | 0.160 |
| TX-03-63 | TFA | 25.4 | 3.6 | 2.6 | 18.2 | 42.0 | 8.2 | 3.5 | | |
| TX-03-63 | TAG | 33.1 | 6.1 | 3.8 | 24.9 | 21.6 | 10.4 | | 1.4 | 0.383 |
| TX-03-45 | TFA | 16.4 | 1.4 | 0.5 | 8.1 | 69.1 | 4.5 | 3.5 | | |
| TX-03-45 | TAG | 30.8 | 4.6 | 1.4 | 16.2 | 40.7 | 6.3 | | 0.2 | 0.058 |
| TX-03-17 | TFA | 14.2 | 1.8 | 0.8 | 6.9 | 71.2 | 5.2 | 3.6 | | |
| TX-03-17 | TAG | 18.7 | 4.5 | 2.2 | 13.5 | 52.8 | 8.3 | | 0.4 | 0.120 |
| TX-03-57 | TFA | 18.7 | 3.4 | 1.5 | 13.8 | 55.8 | 6.8 | 3.6 | | |
| TX-03-57 | TAG | 23.4 | 6.3 | 3.0 | 21.0 | 36.2 | 10.1 | | 1.2 | 0.330 |
| TX-03-11 | TFA | 29.1 | 6.4 | 2.1 | 22.4 | 33.0 | 7.1 | 3.6 | | |
| TX-03-11 | TAG | 30.6 | 8.5 | 2.8 | 27.0 | 19.7 | 11.4 | | 1.9 | 0.510 |
| TX-03-48 | TFA | 27.1 | 3.7 | 3.7 | 20.6 | 37.2 | 7.6 | 3.7 | | |
| TX-03-48 | TAG | 31.2 | 5.0 | 5.5 | 27.1 | 23.0 | 8.1 | | 2.1 | 0.569 |
| TX-03-29 | TFA | 20.1 | 2.3 | 1.7 | 13.4 | 55.5 | 7.1 | 3.7 | | |
| TX-03-29 | TAG | 33.0 | 5.0 | 4.1 | 24.3 | 26.4 | 7.2 | | 0.4 | 0.104 |
| TX-03-26 | TFA | 15.3 | 1.6 | 0.4 | 5.9 | 71.3 | 5.5 | 3.9 | | |
| TX-03-26 | TAG | 25.2 | 4.6 | 1.7 | 13.3 | 49.7 | 5.5 | | 0.3 | 0.074 |
| TX-03-10 | TFA | 28.6 | 6.8 | 2.1 | 21.8 | 33.0 | 7.7 | 3.9 | | |
| TX-03-10 | TAG | 31.0 | 8.5 | 2.9 | 26.7 | 18.6 | 12.2 | | 1.9 | 0.491 |
| TX-03-58 | TFA | 16.3 | 2.6 | 1.3 | 14.5 | 60.3 | 5.0 | 4.1 | | |
| TX-03-58 | TAG | 20.4 | 5.2 | 2.8 | 24.3 | 39.2 | 8.2 | | 1.1 | 0.278 |
| TX-03-08 | TFA | 19.8 | 2.0 | 0.7 | 6.6 | 64.9 | 5.9 | 4.1 | | |
| TX-03-08 | TAG | 34.8 | 5.2 | 2.7 | 14.3 | 34.5 | 8.5 | | 0.2 | 0.051 |
| TX-03-33 | TFA | 27.4 | 2.4 | 1.5 | 16.3 | 46.0 | 6.4 | 4.2 | | |
| TX-03-33 | TAG | 39.2 | 5.4 | 2.3 | 21.9 | 20.8 | 10.5 | | 1.6 | 0.386 |
| TX-03-22 | TFA | 19.8 | 2.8 | 3.1 | 11.8 | 53.4 | 9.1 | 4.2 | | |
| TX-03-22 | TAG | 28.4 | 5.3 | 5.4 | 19.4 | 38.3 | 3.2 | | 1.2 | 0.287 |
| TX-03-41 | TFA | 18.1 | 2.6 | 3.1 | 11.1 | 58.0 | 7.1 | 4.8 | | |
| TX-03-41 | TAG | 27.8 | 6.0 | 6.8 | 19.3 | 34.9 | 5.3 | | 0.7 | 0.139 |
| TX-03-46 | TFA | 24.6 | 2.0 | 0.6 | 7.9 | 57.4 | 7.4 | 4.9 | | |

TABLE 22-continued

TFA and TAG levels, fatty acid composition and TTQ in pOIL103 + pOIL197 primary transformants at boot leaf stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-03-46 | TAG | 44.7 | 4.2 | 1.3 | 13.4 | 31.4 | 5.0 | | 1.1 | 0.220 |
| TX-03-28 | TFA | 28.5 | 2.1 | 1.3 | 23.4 | 33.7 | 11.0 | 6.2 | | |
| TX-03-28 | TAG | 36.0 | 2.9 | 3.1 | 29.6 | 18.5 | 10.0 | | 3.7 | 0.596 |
| TX-03-31 | TFA | 33.4 | 2.9 | 4.3 | 28.6 | 25.5 | 5.5 | 8.3 | | |
| TX-03-31 | TAG | 38.0 | 3.6 | 4.9 | 30.6 | 14.8 | 8.1 | | 6.6 | 0.789 |

TABLE 23

TFA and TAG levels, fatty acid composition and TTQ in pOIL103 + pOIL197 primary transformants at mature seed setting stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-03-52 | TFA | 15.5 | 6.7 | 4.3 | 14.3 | 48.7 | 10.6 | 1.2 | | |
| TX-03-52 | TAG | 12.7 | 7.9 | 8.3 | 21.4 | 41.1 | 8.7 | | 0.4 | 0.315 |
| TX-03-51 | TFA | 15.6 | 6.4 | 4.3 | 13.6 | 52.0 | 8.0 | 1.5 | | |
| TX-03-51 | TAG | 13.7 | 8.9 | 8.2 | 18.6 | 41.2 | 9.5 | | 0.4 | 0.296 |
| TX-03-07 | TFA | 20.6 | 4.2 | 13.1 | 18.1 | 32.1 | 11.9 | 1.6 | | |
| TX-03-07 | TAG | 25.5 | 7.8 | 23.7 | 24.5 | 9.3 | 9.1 | | 0.4 | 0.227 |
| TX-03-04 | TFA | 23.9 | 3.7 | 4.0 | 16.5 | 38.8 | 13.1 | 1.7 | | |
| TX-03-04 | TAG | 35.3 | 6.1 | 9.5 | 24.6 | 14.7 | 9.8 | | 0.2 | 0.110 |
| TX-03-54 | TFA | 16.6 | 5.0 | 6.7 | 16.1 | 45.8 | 9.9 | 1.7 | | |
| TX-03-54 | TAG | 16.6 | 7.2 | 12.4 | 22.7 | 34.2 | 6.9 | | 0.4 | 0.245 |
| TX-03-21 | TFA | 14.4 | 4.2 | 1.0 | 10.0 | 62.7 | 7.7 | 1.8 | | |
| TX-03-21 | TAG | 12.8 | 6.6 | 1.9 | 16.5 | 55.4 | 6.7 | | 0.2 | 0.133 |
| TX-03-08 | TFA | 19.3 | 3.6 | 7.1 | 16.4 | 45.3 | 8.3 | 1.9 | | |
| TX-03-08 | TAG | 23.5 | 7.3 | 16.2 | 24.6 | 19.6 | 8.7 | | 0.4 | 0.213 |
| TX-03-02 | TFA | 16.4 | 4.8 | 7.5 | 22.0 | 39.7 | 9.5 | 1.9 | | |
| TX-03-02 | TAG | 15.1 | 6.4 | 14.0 | 30.3 | 25.6 | 8.7 | | 0.6 | 0.334 |
| TX-03-34 | TFA | 24.2 | 4.9 | 5.2 | 18.2 | 32.4 | 15.2 | 2.0 | | |
| TX-03-34 | TAG | 27.1 | 7.3 | 8.6 | 26.6 | 18.1 | 12.3 | | 0.6 | 0.298 |
| TX-03-17 | TFA | 16.9 | 4.2 | 2.0 | 10.6 | 55.2 | 11.1 | 2.2 | | |
| TX-03-17 | TAG | 19.7 | 6.7 | 3.7 | 18.4 | 41.4 | 10.0 | | 0.2 | 0.107 |
| TX-03-26 | TFA | 19.3 | 3.4 | 0.8 | 9.9 | 57.6 | 9.1 | 2.2 | | |
| TX-03-26 | TAG | 23.9 | 6.7 | 2.0 | 18.2 | 39.3 | 9.9 | | 0.3 | 0.129 |
| TX-03-32 | TFA | 23.2 | 3.9 | 1.7 | 15.5 | 44.5 | 11.2 | 2.3 | | |
| TX-03-32 | TAG | 29.0 | 6.3 | 3.8 | 24.8 | 25.6 | 10.6 | | 0.5 | 0.206 |
| TX-03-41 | TFA | 19.7 | 4.9 | 6.3 | 21.7 | 36.5 | 10.9 | 2.3 | | |
| TX-03-41 | TAG | 20.9 | 7.6 | 11.6 | 29.3 | 20.3 | 10.5 | | 0.8 | 0.331 |
| TX-03-49 | TFA | 21.1 | 5.7 | 14.9 | 19.3 | 27.5 | 11.4 | 2.3 | | |
| TX-03-49 | TAG | 22.6 | 8.3 | 23.7 | 24.7 | 12.0 | 8.8 | | 0.9 | 0.375 |
| TX-03-25 | TFA | 17.9 | 3.2 | 0.6 | 8.7 | 62.6 | 7.1 | 2.6 | | |
| TX-03-25 | TAG | 21.9 | 6.3 | 1.5 | 14.2 | 47.7 | 8.3 | | 0.4 | 0.149 |
| TX-03-40 | TFA | 20.8 | 3.4 | 0.8 | 5.8 | 59.7 | 9.6 | 2.7 | | |
| TX-03-40 | TAG | 27.6 | 6.3 | 0.4 | 8.6 | 46.3 | 10.8 | | 0.7 | 0.238 |
| TX-03-36 | TFA | 22.8 | 4.2 | 2.6 | 15.7 | 45.2 | 9.5 | 2.9 | | |
| TX-03-36 | TAG | 27.1 | 7.1 | 5.0 | 22.9 | 25.1 | 12.9 | | 0.8 | 0.282 |
| TX-03-10 | TFA | 28.4 | 5.3 | 1.7 | 21.5 | 30.3 | 12.7 | 3.3 | | |
| TX-03-10 | TAG | 32.7 | 7.8 | 2.3 | 25.2 | 18.6 | 13.3 | | 1.9 | 0.570 |
| TX-03-46 | TFA | 27.5 | 3.7 | 1.7 | 12.2 | 41.4 | 13.4 | 3.7 | | |
| TX-03-46 | TAG | 36.4 | 5.1 | 1.8 | 15.1 | 29.1 | 12.4 | | 1.6 | 0.420 |
| TX-03-48 | TFA | 26.7 | 5.0 | 6.5 | 24.7 | 24.7 | 12.3 | 4.5 | | |
| TX-03-48 | TAG | 28.6 | 6.1 | 7.6 | 28.2 | 17.6 | 12.0 | | 3.0 | 0.679 |

TABLE 24

TFA and TAG levels, fatty acid composition and TTQ in pOIL104 (pSSU:WRI1) + pOIL197 (pZmUbi:DGAT and pZmUbi:Oleosin) primary transformants at vegetative setting stage.

| Line | TFA or TAG | C16:0 | C18:0 | C18:1 | C18:2 | C18:3n3 | Other | TFA | TAG | TTQ |
|---|---|---|---|---|---|---|---|---|---|---|
| TX-04-02 | TFA | 12.6 | 1.7 | 1.2 | 11.3 | 68.4 | 4.7 | 2.7 | | |
| TX-04-02 | TAG | 19.2 | 8.2 | 3.9 | 29.4 | 35.1 | 4.2 | | 0.0 | 0.008 |
| TX-04-25 | TFA | 12.4 | 1.5 | 0.7 | 8.1 | 72.7 | 4.7 | 3.1 | | |
| TX-04-25 | TAG | 21.9 | 11.7 | 5.3 | 19.8 | 38.3 | 3.0 | | 0.1 | 0.020 |
| TX-04-11 | TFA | 13.5 | 2.0 | 0.5 | 7.2 | 70.8 | 6.0 | 3.2 | | |
| TX-04-11 | TAG | 17.4 | 3.9 | 3.3 | 13.6 | 55.2 | 6.5 | | 0.1 | 0.019 |
| TX-04-27 | TFA | 13.1 | 1.7 | 1.5 | 9.8 | 67.8 | 6.0 | 3.2 | | |
| TX-04-27 | TAG | 18.2 | 3.6 | 2.6 | 24.1 | 44.6 | 6.8 | | 0.4 | 0.134 |
| TX-04-24 | TFA | 12.9 | 1.9 | 0.6 | 7.6 | 72.2 | 4.8 | 3.3 | | |
| TX-04-24 | TAG | 24.2 | 11.4 | 3.7 | 17.3 | 40.5 | 3.1 | | 0.1 | 0.017 |
| TX-04-16 | TFA | 13.0 | 2.9 | 0.8 | 8.9 | 70.0 | 4.5 | 3.4 | | |
| TX-04-16 | TAG | 22.5 | 8.1 | 4.9 | 22.3 | 37.5 | 4.6 | | 0.1 | 0.023 |
| TX-04-30 | TFA | 13.0 | 1.6 | 1.3 | 8.7 | 70.2 | 5.2 | 3.5 | | |
| TX-04-30 | TAG | 18.5 | 3.8 | 2.6 | 22.5 | 46.9 | 5.8 | | 0.3 | 0.072 |
| TX-04-10 | TFA | 18.9 | 2.7 | 1.0 | 8.3 | 60.8 | 8.3 | 3.5 | | |
| TX-04-10 | TAG | 34.0 | 5.5 | 3.2 | 17.7 | 30.0 | 9.5 | | 0.1 | 0.034 |
| TX-04-13 | TFA | 13.0 | 2.0 | 0.7 | 6.4 | 72.7 | 5.1 | 3.5 | | |
| TX-04-13 | TAG | 16.2 | 5.0 | 3.6 | 14.8 | 55.9 | 4.5 | | 0.1 | 0.017 |
| TX-04-19 | TFA | 19.4 | 2.2 | 0.6 | 9.9 | 62.7 | 5.2 | 3.5 | | |
| TX-04-19 | TAG | 30.2 | 4.3 | 3.1 | 24.8 | 33.2 | 4.4 | | 0.1 | 0.025 |
| TX-04-06 | TFA | 11.6 | 1.6 | 1.0 | 11.2 | 69.6 | 5.1 | 3.6 | | |
| TX-04-06 | TAG | 14.1 | 4.5 | 3.4 | 27.9 | 40.6 | 9.4 | | 0.1 | 0.036 |
| TX-04-14 | TFA | 12.9 | 3.3 | 3.3 | 8.6 | 65.7 | 6.1 | 3.6 | | |
| TX-04-14 | TAG | 20.3 | 8.9 | 4.0 | 21.4 | 40.2 | 5.3 | | 0.1 | 0.024 |
| TX-04-04 | TFA | 10.7 | 1.8 | 0.6 | 8.0 | 74.3 | 4.6 | 3.9 | | |
| TX-04-04 | TAG | 11.0 | 10.1 | 3.8 | 17.2 | 56.3 | 1.7 | | 0.2 | 0.044 |
| TX-04-15 | TFA | 17.4 | 2.4 | 1.1 | 12.2 | 60.2 | 6.5 | 4.0 | | |
| TX-04-15 | TAG | 28.5 | 5.6 | 2.2 | 23.3 | 31.6 | 8.9 | | 0.6 | 0.160 |
| TX-04-08 | TFA | 17.5 | 1.9 | 1.9 | 15.1 | 57.5 | 6.1 | 4.0 | | |
| TX-04-08 | TAG | 28.0 | 4.5 | 4.8 | 29.5 | 23.5 | 9.7 | | 0.5 | 0.130 |
| TX-04-22 | TFA | 13.1 | 3.5 | 1.4 | 12.9 | 63.9 | 5.3 | 4.1 | | |
| TX-04-22 | TAG | 17.1 | 7.8 | 4.3 | 29.5 | 33.3 | 8.0 | | 0.6 | 0.150 |
| TX-04-09 | TFA | 13.7 | 2.4 | 4.1 | 20.4 | 53.8 | 5.5 | 4.1 | | |
| TX-04-09 | TAG | 17.4 | 5.3 | 9.5 | 38.1 | 20.6 | 9.1 | | 0.6 | 0.158 |

The chimeric DNA constructs for *Agrobacterium*-mediated transformation are used to transform *Zea mays* (corn) as described by Gould et al. (1991). Briefly, shoot apex explants are co-cultivated with transgenic *Agrobacterium* for two days before being transferred onto a MS salt media containing kanamycin and carbenicillin. After several rounds of sub-culture, transformed shoots and roots spontaneously form and are transplanted to soil. The constructs are similarly used to transform *Hordeum vulgare* (barley) and *Avena sativa* (oats) using transformation methods known for these species. Briefly, for barley, the *Agrobacterium* cultures are used to transform cells in immature embryos of barley (cv. Golden Promise) according to published methods (Tingay et al., 1997; Bartlett et al., 2008) with some modifications in that embryos between 1.5 and 2.5 mm in length are isolated from immature caryopses and the embryonic axes removed. The resulting explants are co-cultivated for 2-3 days with the transgenic *Agrobacterium* and then cultured in the dark for 4-6 weeks on media containing timentin and hygromycin to generate embryogenic callus before being moved to transition media in low light conditions for two weeks. Calli are then transferred to regeneration media to allow for the regeneration of shoots and roots before transfer of the regenerated plantlets to soil. Transformed plants are obtained and grown to maturity in the glasshouse.

Example 6. Modifying Traits in Dicotyledonous Plants

Oil content in the dicotyledonous plant species *Trifolium repens* (clover), a legume commonly used as a pasture species, was increased by expressing the combination of WRI1, DGAT and Oleosin genes in vegetative parts. The construct pJP3502 was used to transform *T. repens* by *Agrobacterium*-mediated transformation (Larkin et al., 1996). Briefly, the genetic construct pJP3502 was introduced into *A. tumefaciens* via a standard electroporation procedure. The binary vector also contained a 35S:NptII selectable marker gene within the T-DNA. The transformed *Agrobacterium* cells were grown on solid LB media supplemented with kanamycin (50 mg/L) and rifampicin (25 mg/L) and incubated at 28° C. for two days. A single colony was used to initiate a fresh culture. Following 48 hours vigorous culture, the *Agrobacterium* cells was used to treat *T. repens* (cv. Haifa) cotyledons that had been dissected from imbibed seed as described by Larkin et al. (1996). Following co-cultivation for three days the explants were exposed to 25 mg/L kanamycin to select transformed shoots and then transferred to rooting medium to form roots, before transfer to soil.

Six transformed plants containing the T-DNA from pJP3502 were obtained and transferred to soil in the glasshouse. Increased oil content was observed in the non-seed tissue of some of the plants, with one plant showing greater than 4-fold increase in TAG levels in the leaves. Such plants are useful as animal feed, for example by growing the plants in pastures, providing feed with an increased energy content per unit weight (energy density) and resulting in increased growth rates in the animals.

The construct pJP3502 is also used to transform other leguminous plants such as alfalfa (*Medicago sativa*) and barrel medic (*Medicago truncatula*) by the method of Wright et al. (2006) to obtain transgenic plants which have increased TAG content in vegetative parts. The transgenic plants are useful as pasture species or as hay or silage as a source of feed for animals such as, for example, cattle, sheep and horses, providing an increased energy density in the feed.

Example 7. Modification of Plastidial GPAT Expression

Over-Expression of Plastidial GPAT in Plant Cells

A number of experiments were performed to test the hypothesis that the presence of a highly active 16:3 prokaryotic pathway in a plant (i.e. a so-called 16:3 plant) would provide much lower TAG levels in vegetative tissues upon introduction of the gene combination on pJP3502, relative to 18:3 plants. These experiments are described in the following Examples. Initially, the inventors tested whether the high level TAG accumulation observed in transgenic *N. benthamiana* could be disrupted by over-expression of a plastidial GPAT, increasing the flux in the prokaryotic pathway.

A coding region for expression of the *Arabidopsis thaliana* plastidial GPAT, ATS1 (Nishida et al., 1993), was amplified by RT-PCR from *A. thaliana* total RNA and cloned as an EcoRI-PstI fragment into the binary expression vector pJP3343 under the control of the 35S promoter to produce the constitutive expression vector pOIL098. The effect of over-expressing a plastidial GPAT in a high oil leaf background is determined by infiltration of the chimeric vector pOIL098 into high oil leaf tissue. The high oil leaf tissue is generated either by co-infiltration of WRI1 and DGAT binary expression vectors (Example 1) or by infiltrating pOIL098 into leaves of a *Nicotiana* plant stably transformed with the T-DNA from pJP3502 or another high oil vector. Oil content is expected to be reduced in the infiltrated leaf spots co-expressing the ATS1-encoding gene. This is determined by analysing TFA and TAG as proportions of sample dry mass. This is also determined by observing incorporation of labelled acetate into fatty acids produced by microsomes or leaf lysates made from infiltrated leaf spots.

Oil Accumulation in a Plastidial GPAT Mutant of *Arabidopsis thaliana*

The ats1 mutant of *A. thaliana* has a disruptive mutation in the gene encoding plastidial GPAT which reduced plastidial GPAT activity to a level of only 3.8% of the wild-type (Kunst et al., 1988). Non-seed TAG accumulation levels, at least in leaves, stems and roots, in both parental and ats1 mutant *A. thaliana* is tested and compared. The T-DNA of the pJP3502 construct for over-expression of the combination of genes encoding WRI1, DGAT and Oleosin is introduced by transformation into plants of both genotypes. The gene combination in the T-DNA of pJP3502 increases fatty acid synthesis in both plant backgrounds. However, the accumulation of TAG in the ats1 mutant is expected to be significantly higher on average than in the transgenic plants derived from the wild-type (parental) genotype due to the reduction in plastidial GPAT activity and therefore the reduced flux of fatty acids into the plastidial prokaryotic pathway. The ratio of the fatty acids C16:3 to C18:3 is significantly reduced in leaves of the ats1 mutant, both transformed and untransformed.

Silencing the Gene Encoding Plastidial GPAT in Plant Cells

In addition to genetically modifying a plant by introducing a mutation in a gene encoding a plastidial GPAT, the flux of fatty acids through the prokaryotic 16:3 pathway can be reduced and thereby increase oil content in vegetative parts by silencing the plastidial GPAT. This is demonstrated by producing a transgenic cassette having a constitutive or leaf-specific promoter expressing an RNA hairpin corresponding to a region of the gene encoding the plastidial GPAT from the selected species. As an example, an RNAi hairpin expression cassette is produced using the 581 bp SalI-EcoRV fragment of the *A. thaliana* plastidial GPAT cDNA sequence (NM_179407, SEQ ID NO:177). A region of any gene encoding a plastidial GPAT which has a high degree of sequence identity to the nucleotide sequence of NM_179407 can also be used to construct a gene for expression of a hairpin RNA for silencing an endogenous plastidial GPAT gene. A hpRNAi construct containing a 732 bp fragment (SEQ ID NO:210) of the *N. benthamiana* plastidial GPAT flanked by SmaI and KasI unique sites was designed for stable transformation into *N. tabacum*. The synthesized *N. benthamiana* plastidial GPAT fragment was subcloned into the SmaI-KasI sites of pJP3303, resulting in pOIL113. It is expected that reducing plastidial fatty acid retention will result in an increase in TAG accumulation, particularly when combined with a "Push" component such as over-expression of a transcription factor such as WRI1, or by a "Pull" component such as a DGAT or PDAT, and/or reduced SDP1 or TGD activity.

Inactivation of the gene encoding a plastidial GPAT or indeed any gene can be achieved using CRISPR/Cas9 methods. For example, inactivation of the gene encoding *A. thaliana* plastidial GPAT (Accession No. NM_179407) can be carried out by CRISPR/Cas9/sgRNA-mediated gene disruption and subsequent mutagenesis by non homologous end joining (NHEJ) DNA repair. Before targeted DNA cleavage, Cas9 stimulates DNA strand separation and allows a sgRNA to hybridize with a specific 20 nt sequence in the targeted gene. This positions the target DNA into the active site of Cas9 in proper orientation in relation to a PAM (tandem guanosine nucleotides) binding site. This positioning allows separate nuclease domains of Cas9 to independently cleave each strand of the target DNA sequence at a point 3-nt upstream of the PAM site. The double-strand break then undergoes error-prone NHEJ DNA repair during which deletions or insertions of a few nucleotides occur and result in inactivation of the plastidial GPAT gene. SgRNA sequences targeting the *A. thaliana* GPAT gene are identified and selected through the use of the CRISPRP web tool (Xie et al., 2014). The 20 nt target sequence can be any 20 nt sequence within the target gene, including within non-coding regions of the gene such as a promoter or intron, provided that it is a specific sequence within the genome. The sequence can be inserted into a binary vector containing the CRISPR/Cas9/sgRNA expression cassette and kanamycin plant selectable marker (Jiang et al., 2013) and transformed into the plant cells by *Agrobacterium*-mediated transformation. Transgenic T1 plants can be screened for mutations in the plastidial GPAT gene by PCR amplification and DNA sequencing.

Example 8. Increasing Expression of Thioesterase in Plant Cells

De novo fatty acid synthesis takes place in the plastids of eukaryotic cells where the fatty acids are synthesized while bound to acyl carrier protein as acyl-ACP conjugates. Following chain elongation to C16:0 and C18:0 acyl groups and then desaturation to C18:1 while linked to ACP, the fatty acids are cleaved from the ACP by thioesterases and enter the eukaryotic pathway by export from the plastids and transport to the ER where they participate in membrane and storage lipid biogenesis. In chloroplasts, the export process has two steps: firstly, acyl chains are released as free fatty acids by the enzymatic activity of acyl-ACP thioesterases (fatty acyl thioesterase; FAT), secondly by reaction with CoA to form acyl-CoA esters which is catalysed by long chain acyl-CoA synthetases (LACS). *A. thaliana* contains 3 fatty acyl thioesterases which can be distinguished based on their acyl chain specificity. FATA1 and FATA2 preferentially hydrolyze unsaturated acyl-ACPs while saturated acyl-ACP chains are typically cleaved by FATB.

To explore the effect upon total fatty acid content, TAG content, and fatty acid composition of the co-expression of a thioesterase and genes encoding the WRI1 and/or DGAT polypeptides, chimeric genes were made for each of the three *A. thaliana* thioesterases by insertion of the coding regions into the pJP3343 binary expression vector for transient expression in *N. benthamiana* leaf cells from the 35S promoter. Protein coding regions for the *A. thaliana* FATA1 (Accession No. NP_189147.1, SEQ ID NO:193) and FATA2 (Accession No. NP_193041.1, SEQ ID NO:194) thioesterases were amplified from silique cDNA using primers containing EcoRI and PstI sites and subsequently cloned into pJP3343 using the same restriction sites. The resulting expression vectors were designated pOIL079 and pOIL080, respectively. The protein coding region of the *A. thaliana* FATB gene (Accession No. NP_172327.1, SEQ ID NO:195) was amplified using primers containing NotI and SacI flanking sites and cloned into the corresponding restriction sites of pJP3343, resulting in pOIL081. Constructs pOIL079, pOIL080 and pOIL081 are infiltrated into *N. benthamiana* leaf tissue, either individually or in combination with constructs containing the genes for the *A. thaliana* WRI1 transcription factor (AtWRI1) (pJP3414) and/or DGAT1 acyltransferase (AtDGAT1) (pJP3352). For comparison, chimeric genes encoding the *Cocos nucifera* FatB1 (CnFATB1) (pJP3630), *C. nucifera* FatB2 (CnFATB2) (pJP3629) were introduced into *N. benthamiana* leaf tissue in parallel with the *Arabidopsis* thioesterases, to compare the effect of the FatB polypeptides having MCFA specificity to the *Arabidopsis* thioesterases which do not have MCFA specificity. All of the infiltrations included a chimeric gene for expression of the p19 silencing suppressor as described in Example 1. The negative control infiltrated only the p19 T-DNA.

A synergistic effect was observed between thioesterase expression and WRI1 and/or DGAT over-expression on TAG levels in *N. benthamiana* leaves. Expression of the thioesterase genes without the WRI1 or DGAT genes significantly increased TAG levels above the low level in the negative control (p19 alone). For example, expression of the coconut FATB2 thioesterase resulted in an 8.2-fold increase in TAG levels in the leaves compared to the negative control. Co-expression of the *A. thaliana* WRI1 transcription factor with each of the thioesterases further increased TAG levels compared to the AtWRI1 control. Co-expression of each of the coconut thioesterases CnFATB1 and CnFATB2 with WRI1 resulted in higher TAG levels than each of the three *A. thaliana* thioesterases with WRI1. Interestingly, the converse was observed when the *A. thaliana* DGAT1 acyltransferase was co-expressed in combination with a thioesterase and WRI1. This suggested a better match in acyl-chain specificity of the *A. thaliana* thioesterases and the *A. thaliana* DGAT1 acyltransferase, resulting in a greater flux of acyl-chains from the acyl-ACP into TAG. The non-MCFA thioesterases were also considerably more effective in elevating the percentage of oleic acid in the total fatty acid content in the leaves. Co-expression of the AtWRI1, AtDGAT1 and AtFATA2 resulted in the greatest level of TAG in the leaves, providing a level which was 1.6-fold greater than when AtWRI1 and AtDGAT1 were co-expressed without the thioesterase. These experiments confirmed the synergistic increase in oil synthesis and accumulation when both WRI1 and DGAT were co-expressed as well as showing the further synergistic increase obtained by adding a thioesterase to the combination.

Three different binary expression vectors were constructed to test the effect of co-expression of genes encoding WRI1, DGAT1 and FATA on TAG levels and fatty acid composition in stably transformed *N. tabacum* leaves. The vector pOIL121 contained an SSU::AtWRI1 gene for expression of AtWRI1 from the SSU promoter, a 35S::AtDGAT1 gene for expression of AtDGAT from the 35S promoter, and an enTCUP2::AtFATA2 gene for expression of AtFATA2 from the enTCUP2 promoter which is a constitutive promoter. These genetic constructs were derived from pOIL38 by first digesting the DNA with NotI to remove the gene coding for the *S. indicum* oleosin. The protein coding region of the *A. thaliana* FATA2 gene was amplified and flanked with NotI sites using pOIL80 DNA as template. This fragment was then inserted into the NotI site of pOIL38. pOIL121 then served as a parent vector for pOIL122 which contained an additional enTCUP2::SDP1 hairpin RNA cassette for RNAi-mediated silencing of the endogenous SDP1 gene in the transgenic plants. To do this, the entire *N. benthamiana* SDP1 hairpin cassette was isolated from pOIL51 (Example 2) as an SfoI-SmaI fragment and cloned into the SfoI site of pOIL121, producing pOIL122 (FIG. 14). A third vector, pOIL123, containing the SSU::WRI1 and 35S::DGAT1 genes and the enTCUP2::SDP1 hairpin RNA gene was obtained in a similar way by cloning the enTCUP2::SDP1 hairpin RNA cassette as a SfoI-SmaI fragment into the SfoI site of pOIL36.

In summary, the vectors contained the gene combinations:
pOIL121: SSU::AtWRI1, 35S::AtDGAT1, enTCUP2::AtFATA2.
pOIL122: SSU::AtWRI1, 35S::AtDGAT1, enTCUP2::AtFATA2, enTCUP2::SDP1 hairpin.
pOIL123: SSU::AtWRI1, 35S::AtDGAT1, enTCUP2::SDP1 hairpin.

The three constructs were each used to produce transformed *N. tabacum* plants (cultivar Wi38) by *Agrobacterium*-mediated transformation. Co-expression of the *A. thaliana* FATA2 thioesterase or silencing of the endogenous SDP1 TAG lipase in combination with AtWRI1 and AtDGAT1 expression each resulted in further elevated TAG levels compared to expression of AtWRI1 and AtDGAT1 in the absence of both of the thioesterase gene and the SDP1-silencing gene. The greatest TAG yields were obtained using pOIL122 by the combined action of all four chimeric genes.

It is noted that *N. benthamiana* is an 18:3 plant. The same constructs pOIL079, pOIL080 and pOIL081 are used to transform *A. thaliana*, a 16:3 plant.

The inventors conceived of the model that increasing plastidial fatty acid export such as by increased fatty acyl thioesterase activity reduces acyl-ACP accumulation in the plastids, thereby increasing fatty acid biosynthesis as a result of reduced feedback inhibition on the acetyl-CoA carboxylase (ACCase) (Andre et al., 2012; Moreno-Perez et al., 2012). Thioesterase over-expression increases export of acyl chains from the plastids into the ER, thereby providing an efficient link between so-called 'Push' and 'Pull' metabolic engineering strategies.

Example 9. The Effect of Different Transcription Factor Polypeptides on Plant Traits Previously reported experiments with WRI1 and DGAT (Vanhercke et al., 2013) used a synthetic gene encoding *A. thaliana* AtWRI1 (Accession No. AAP80382.1) and a synthetic gene encoding AtDGAT1, also from *A. thaliana* (Accession No. AAF19262; SEQ ID NO: 1). To compare other WRI polypeptides with AtWRI1 for their ability to combine with DGAT to increase oil content, other WRI coding sequences were identified and used to generate constructs for expression in *N. benthamiana* leaves. Nucleotide sequences encoding the *A. thaliana* WRI3 (Accession No. AAM91814.1, SEQ ID NO:196) and WRI4 (Accession No. NP_178088.2, SEQ ID NO:197) transcription factors (To et al., 2012) were synthesized and inserted as EcoRI fragments into pJP3343 under the control of the 35S promoter. The resulting binary expression vectors were designated pOIL027 and pOIL028, respectively. The coding sequence for the oat (*Avena sativa*) WRI1 (AsWRI1, SEQ ID NO:198) was PCR amplified from a vector provided by Prof. Sten Stymne (Swedish University of Agricultural Sciences) using flanking primers containing additional EcoRI sites. The amplified fragment was inserted into pJP3343 resulting in pOIL055. A WRI1 candidate sequence from *S. bicolor* (Accession No. XP_002450194.1, SEQ ID NO:199) was identified by a BLASTp search on the NCBI server using the *Zea mays* WRI1 amino acid sequence (Accession No. NP_001137064.1, SEQ ID NO:200) as query. The protein coding region of the *S. bicolor* WRI1 gene (SbWRI1) was synthesized and inserted as an EcoRI fragment into pJP3343, yielding pOIL056. A gene candidate encoding a WRI1 was identified from the Chinese tallow (*Triadica sebifera*; TsWRI1, SEQ ID NO:201) transcriptome (Uday et al., submitted). The protein coding region was synthesized and inserted as an EcoRI fragment into pJP3343 resulting in pOIL070. The pJP3414 and pJP3352 binary vectors containing the coding sequences for expression of the *A. thaliana* WRI1 and DGAT1 polypeptides were as described by Vanhercke et al. (2013).

Plasmids containing the various WRI coding sequences were introduced into *N. benthamiana* leaf tissue for transient expression using a gene encoding the p19 viral suppressor protein in all inoculations as described in Example 1. The genes encoding the WRI polypeptides were either tested alone or in combination with the DGAT1 acyltransferase gene, the latter to provide greater TAG biosynthesis and accumulation. The positive control in this experiment was the combination of the genes encoding *A. thaliana* WRI1 transcription factor and AtDGAT1. All infiltrations were done in triplicate using three different plants and TAG levels were analyzed as described in Example 1. Expression of most of the individual WRI polypeptides in the absence of exogenously added DGAT1 resulted in increased, yet still low, TAG levels (<0.23% on dry weight basis) in infiltrated leaf spots, compared to the control which had only the p19 construct (FIG. 15). The exception was TsWRI1 which, by itself, did not appear to increase TAG levels significantly. In addition, differences in TAG levels produced by expression of the different WRI transcription factors on their own were not great. Both AsWRI1 and SbWRI1 yielded TAG levels similar to AtWRI1 on its own. Analysis of the TAG fatty acid composition revealed only minor changes except for increased C18:1Δ9 levels from expression of AtWRI3 in the infiltrated leaf tissues (Table 25).

TABLE 25

TAG fatty acid composition in *N. benthamiana* leaf samples infiltrated with different chimeric genes for expression of WRI (n = 3). All samples were also infiltrated with the P19 construct. The TAG samples also contained 0.1-0.4% C14:0; 0.5-1.2% C16:3 and; 0.1-0.7% C18:1411.

| Infiltrated genes | C16:0 | C16:1 | C18:0 | C18:1 | C18:2 | C18:3n3 | C20:0 | C20:1 | C22:0 | C24:0 |
|---|---|---|---|---|---|---|---|---|---|---|
| Control (P19) | 33.6 ± 4.7 | 0.5 ± 0.4 | 8.9 ± 2.2 | 4.7 ± 0.6 | 16.9 ± 1.0 | 32.2 ± 7.8 | 1.1 ± 0.2 | 0.8 ± 1.5 | 0.0 | 0.0 |
| WRI1 | 35.5 ± 3.4 | 0.7 ± 0.2 | 5.2 ± 0.8 | 5.4 ± 1.3 | 17.1 ± 1.0 | 33.1 ± 2.7 | 0.8 ± 0.1 | 0.5 ± 0.6 | 0.3 ± 0.0 | 0.0 |
| WRI3 | 27.3 ± 1.6 | 0.9 ± 0.2 | 4.8 ± 0.3 | 10.2 ± 1.5 | 16.1 ± 1.0 | 37.8 ± 1.2 | 0.8 ± 0.1 | 0.6 ± 0.7 | 0.1 ± 0.2 | 0.0 |
| WRI4 | 30.1 ± 0.4 | 1.0 ± 0.4 | 5.2 ± 0.8 | 4.6 ± 0.6 | 17.2 ± 0.4 | 38.1 ± 1.6 | 0.8 ± 0.1 | 1.3 ± 1.3 | 0.0 | 0.0 |
| AsWRI | 35.7 ± 3.0 | 1.7 ± 0.4 | 5.3 ± 0.7 | 6.5 ± 0.3 | 15.4 ± 0.4 | 31.6 ± 1.6 | 0.8 ± 0.1 | 0.4 ± 0.7 | 0.3 ± 0.1 | 0.0 |
| SbWRI | 37.4 ± 0.8 | 1.9 ± 0.3 | 4.8 ± 0.3 | 7.0 ± 1.2 | 15.2 ± 0.3 | 30.8 ± 0.3 | 0.8 ± 0.1 | 0.4 ± 0.6 | 0.3 ± 0.0 | 0.0 |
| TsWRI | 34.5 ± 4.8 | 0.0 | 9.4 ± 8.2 | 5.9 ± 1.7 | 16.0 ± 0.7 | 29.3 ± 12.4 | 0.0 | n.d. | 0.0 | 0.0 |
| Control (P19) | 31.0 ± 2.1 | 0.9 ± 0.1 | 8.7 ± 1.3 | 8.0 ± 2.3 | 24.9 ± 1.5 | 22.1 ± 4.7 | 2.0 ± 0.1 | 0.0 | 0.6 ± 0.6 | 0.2 ± 0.4 |
| WRI1 + DGAT | 27.7 ± 0.1 | 0.3 ± 0.0 | 7.0 ± 0.1 | 17.2 ± 0.7 | 27.9 ± 0.9 | 14.7 ± 0.3 | 2.4 ± 0.2 | 0.3 ± 0.0 | 1.1 ± 0.1 | 0.8 ± 0.2 |
| WRI3 + DGAT | 30.0 ± 0.8 | 0.6 ± 0.1 | 5.9 ± 0.4 | 13.9 ± 2.9 | 21.5 ± 1.1 | 21.3 ± 0.8 | 2.8 ± 0.1 | 0.2 ± 0.0 | 1.8 ± 0.1 | 1.0 ± 0.2 |
| WRI4 + DGAT | 27.0 ± 0.5 | 0.2 ± 0.1 | 8.5 ± 0.2 | 5.8 ± 0.7 | 23.9 ± 0.8 | 25.2 ± 1.3 | 3.5 ± 0.1 | 0.2 ± 0.0 | 2.1 ± 0.2 | 1.7 ± 0.2 |
| AsWRI + DGAT | 33.8 ± 0.5 | 1.1 ± 0.1 | 5.5 ± 0.9 | 12.2 ± 1.6 | 26.0 ± 1.9 | 16.3 ± 1.3 | 2.2 ± 0.2 | 0.2 ± 0.0 | 1.2 ± 0.1 | 0.8 ± 0.1 |
| SbWRI + DGAT | 34.6 ± 0.5 | 1.3 ± 0.1 | 5.6 ± 0.4 | 13.9 ± 1.6 | 23.6 ± 1.3 | 15.8 ± 0.6 | 2.2 ± 0.1 | 0.2 ± 0.0 | 1.2 ± 0.1 | 0.9 ± 0.1 |
| TsWRI + DGAT | 25.4 ± 0.5 | 0.2 ± 0.0 | 9.4 ± 0.1 | 7.7 ± 1.0 | 27.0 ± 1.3 | 22.1 ± 2.4 | 3.6 ± 0.2 | 0.2 ± 0.0 | 1.8 ± 0.2 | 1.3 ± 0.2 |

In contrast, differences in TAG yields from expression of the different WRI polypeptides were more pronounced upon co-expression with the AtDGAT1 acyltransferase. This again demonstrated the synergistic effect of WRI1 and DGAT co-expression on TAG biosynthesis in infiltrated *N. benthamiana* leaf tissue, as reported by Vanhercke et al. (2013). Intermediate TAG levels were observed upon co-expression of DGAT1 with AtWRI3, AtWRI4 and TsWRI1 expressing vectors while levels obtained with the AsWRI1 and AtWRI1 were significantly lower. In a result that could not have been predicted beforehand, the highest TAG yields were obtained with co-expression of DGAT with SbWRI1, even though the assay was done in dicotyledonous cells. TAG fatty acid composition analysis revealed increased levels of $C18:1^{\Delta 9}$ and decreased levels of $C18:3^{\Delta 9,12,15}$ (ALA) in the case of SbWRI1, AsWRI1 and the AtWRI1 positive control. Unlike AtWRI1, however, expression of AsWRI1 and SbWRI1 both displayed increased C16:0 levels compared to the p19 negative control. Interestingly, AtWRI3 infiltrated leaf samples exhibited a distinct TAG profile with C18:1$^{\Delta 9}$ being enriched while C16:0 and ALA were only slightly affected.

This experiment showed that the *S. bicolor* WRI1 transcription factor, SbWRI1, was superior to AtWRI1 when co-expressed with DGAT to increase TAG levels in vegetative plant parts. The inventors also concluded that a transcription factor, for example a WRI1, from a monocotyledonous plant could function well in a dicotyledonous plant cell, indeed might even have superior activity compared to a corresponding transcription factor from a dicotyledonous plant. Likewise, a transcription factor from a dicotyledonous plant could function well in a monocotyledonous plant cell.

Use of Other Transcription Factors

Genetic constructs were prepared for expression of each of 14 different transcription factors in plant cells to test their ability to function for increasing TAG levels in combination with other genes involved in TAG biosynthesis and accumulation. These transcription factors were candidates as alternatives for WRI1 or for addition to combinations including one or more of WRI1, LEC1 and LEC2 transcription factors for use in plant cells, particularly in vegetative plant parts. Their selection was largely based on their reported involvement in embryogenesis (reviewed in Baud and Lepiniec (2010), and Ikeda et al. (2006)), similar to LEC2. Experiments were therefore carried out to assay their function, using the *N. benthamiana* expression system (Example 1), as follows.

Nucleotide sequences of the protein coding regions of the following transcription factors were codon optimized for expression in *N. benthamiana* and *N. tabacum*, synthesized and subcloned as NotI-SacI fragments into the respective sites of pJP3343: *A. thaliana* FUS3 (pOIL164) (Luerssen et al., 1998; Accession number AAC35247; SEQ ID NO:160), *A. thaliana* LEC1L (pOIL165) (Kwong et al. 2003; Accession number AAN15924; SEQ ID NO:157), *A. thaliana* LEC1 (pOIL166) (Lotan et al., 1998; Accession number AAC39488; SEQ ID NO:149), *G. max* MYB73 (pOIL167) (Liu et al., 2014; Accession number ABH02868; SEQ ID NO:212), *A. thaliana* bZIP53 (pOIL168) (Alonso et al., 2009; Accession number AAM14360; SEQ ID NO:213), *A. thaliana* AGL15 (pOIL169) (Zheng et al., 2009; Accession number NP_196883; SEQ ID NO:214), *A. thaliana* MYB118 (Accession number AAS58517; pOIL170; SEQ ID NO:215), MYB115 (Wang et al., 2002; Accession number AAS10103; pOIL171; SEQ ID NO:216), *A. thaliana* TANMEI (pOIL172) (Yamagishi et al., 2005; Accession number BAE44475; SEQ ID NO:217), *A. thaliana* WUS (pOIL173) (Laux et al., 1996; Accession number NP_565429; SEQ ID NO:218), *A. thaliana* BBM (pOIL174) (Boutilier et al., 2002; Accession number AAM33893, SEQ ID NO:145), *B. napus* GFR2a1 (Accession number AFB74090; pOIL177; SEQ ID NO:219) and GFR2a2 (Accession number AFB74089; pOIL178; SEQ ID NO:220) (Liu et al. (2012)). In addition, a codon optimized version of the *A. thaliana* PHR1 transcription factor involved in adaptation to high light phosphate starvation conditions was similarly subcloned into pJP3343 (pOIL189) (Nilsson et al (2012); Accession number AAN72198; SEQ ID NO:221). These transcription factors are summarised in Table 26.

As a screening assay to determine the function of these transcription factors, the genetic constructs and a gene encoding DGAT1 were co-infiltrated into *N. benthamiana* leaf cells as described in Example 1, either with or without a gene encoding WRI1. Total lipid content and fatty acid composition of the leaf cells were analysed 5 days post-infiltration. Among the various embryogenic transcription factors tested, only overexpression of FUS3 resulted in significantly increased TAG levels in *N. benthamiana* leaf tissue when compared to DGAT and DGAT1+WRI1 control infiltrations (Table 27).

TABLE 26

Additional transcription factors and the genetic constructs for their expression

| Plasmid | Transcription factor | Species | Length (amino acid) | Accession number |
|---|---|---|---|---|
| pOIL164 | FUS3 | *A. thaliana* | 312 | AAC35247 |
| pOIL165 | LEC1L | *A. thaliana* | 234 | AAN15924 |
| pOIL166 | LEC1 | *A. thaliana* | 208 | AAC39488 |
| pOIL167 | MYB73 | *G. max* | 74 | ABH02868 |
| pOIL168 | bZIP53 | *A. thaliana* | 146 | AAM14360 |
| pOIL169 | AGL15 | *A. thaliana* | 268 | NP_196883 |
| pOIL170 | MYB118 | *A. thaliana* | 437 | AAS58517 |
| pOIL171 | MYB115 | *A. thaliana* | 359 | AAS10103 |
| pOIL172 | TANMEI | *A. thaliana* | 386 | BAE44475 |
| pOIL173 | WUS | *A. thaliana* | 292 | NP_565429 |
| pOIL174 | BBM | *A. thaliana* | 584 | AAM33803 |
| pOIL177 | GFR2a1 | *B. napus* | 453 | AFB74090 |
| pOIL178 | GFR2a2 | *B. napus* | 461 | AFB74089 |
| pOIL189 | PHR1 | *A. thaliana* | 409 | AAN72198 |

TABLE 27

TAG level (% leaf dry weight) and fatty acid profile of infiltrated *N. benthamiana* leaves.

| | C16:0 | C16:1 | C18:0 | C18:1 | C18:2 | C18:3 | TAG |
|---|---|---|---|---|---|---|---|
| P19 | 27.1 ± 1.5 | 0.3 ± 0.1 | 9.6 ± 1.7 | 4.4 ± 1.2 | 22.4 ± 4.0 | 30.5 ± 0.9 | 0.0 |
| P19 + DGAT1 | 26.3 ± 1.0 | 0.1 ± 0.0 | 10.7 ± 0.6 | 3.7 ± 0.7 | 26.1 ± 1.6 | 26.4 ± 1.4 | 0.2 ± 0.0 |
| P19 + DGAT1 + FUS3 | 24.1 ± 1.0 | 0.1 ± 0.0 | 6.3 ± 0.4 | 5.2 ± 1.6 | 27.9 ± 1.8 | 30.0 ± 1.8 | 0.6 ± 0.1 |
| P19 + DGAT1 + LEC1L | 26.0 ± 1.4 | 0.1 ± 0.0 | 10.3 ± 0.8 | 3.9 ± 1.0 | 26.6 ± 2.1 | 26.4 ± 0.7 | 0.2 ± 0.0 |
| P19 | 30.3 ± 0.7 | 0.0 | 12.4 ± 0.7 | 6.8 ± 0.9 | 22.9 ± 0.2 | 26.0 ± 0.9 | 0.0 |
| P19 + DGAT1 | 25.8 ± 1.1 | 0.0 | 10.1 ± 0.4 | 4.4 ± 0.9 | 26.1 ± 1.3 | 26.2 ± 1.4 | 0.2 ± 0.0 |
| P19 + DGAT1 + WRI1 | 22.7 ± 0.9 | 0.0 | 10.1 ± 0.4 | 14.9 ± 0.5 | 27.9 ± 1.3 | 18.5 ± 0.8 | 0.3 ± 0.1 |
| P19 + DGAT1 + FUS3 | 23.9 ± 0.7 | 0.2 ± 0.1 | 7.6 ± 0.4 | 5.3 ± 0.7 | 29.1 ± 0.8 | 26.8 ± 0.7 | 0.4 ± 0.1 |
| P19 + DGAT1 + LEC1 | 24.9 ± 0.4 | 0.1 ± 0.2 | 11.1 ± 0.2 | 4.0 ± 0.1 | 25.9 ± 0.5 | 26.1 ± 0.6 | 0.1 ± 0.0 |
| P19 + DGAT1 + MYB73 | 25.8 ± 0.3 | 0.0 | 10.9 ± 0.7 | 4.3 ± 1.0 | 26.2 ± 0.8 | 25.2 ± 1.8 | 0.1 ± 0.0 |
| P19 | 34.2 ± 4.9 | 0.0 | 10.6 ± 3.1 | 8.3 ± 4.1 | 19.5 ± 1.4 | 23.2 ± 0.8 | 0.1 ± 0.1 |
| P19 + DGAT1 | 27.7 ± 0.1 | 0.3 ± 0.1 | 9.9 ± 1.1 | 4.2 ± 0.3 | 26.4 ± 1.8 | 22.5 ± 0.4 | 0.2 ± 0.1 |
| P19 + DGAT1 + WRI1 | 24.8 ± 1.0 | 0.2 ± 0.0 | 8.8 ± 1.0 | 14.7 ± 0.6 | 27.6 ± 1.0 | 17.2 ± 0.3 | 0.4 ± 0.1 |
| P19 + DGAT1 + bZIP53 | 29.3 ± 0.8 | 0.1 ± 0.2 | 8.7 ± 0.4 | 2.9 ± 0.3 | 22.0 ± 0.5 | 25.9 ± 0.5 | 0.1 ± 0.1 |
| P19 + DGAT1 + AGL15 | 29.2 ± 1.4 | 0.2 ± 0.0 | 4.9 ± 0.9 | 7.0 ± 1.9 | 19.8 ± 0.8 | 30.0 ± 1.3 | 0.3 ± 0.1 |
| P19 + DGAT1 + MYB118 | 31.6 ± 1.7 | 0.2 ± 0.1 | 5.8 ± 1.2 | 4.8 ± 0.8 | 20.7 ± 0.3 | 28.2 ± 1.6 | 0.2 ± 0.1 |

TABLE 27-continued

TAG level (% leaf dry weight) and fatty acid profile of infiltrated *N. benthamiana* leaves.

| | C16:0 | C16:1 | C18:0 | C18:1 | C18:2 | C18:3 | TAG |
|---|---|---|---|---|---|---|---|
| P19 | 27.4 ± 1.2 | 0.0 | 6.9 ± 1.0 | 4.8 ± 2.6 | 20.0 ± 1.5 | 39.0 ± 4.1 | 0.1 ± 0.0 |
| P19 + DGAT1 | 26.0 ± 1.1 | 0.0 | 8.0 ± 0.6 | 4.2 ± 1.6 | 22.3 ± 2.4 | 33.9 ± 4.3 | 0.2 ± 0.0 |
| P19 + DGAT1 + WRI1 | 23.4 ± 0.8 | 0.1 ± 0.1 | 8.5 ± 0.6 | 17.0 ± 2.4 | 23.3 ± 1.8 | 23.3 ± 4.3 | 0.5 ± 0.1 |
| P19 + DGAT1 + MYB115 | 26.3 ± 0.4 | 0.1 ± 0.1 | 6.6 ± 0.3 | 2.8 ± 0.4 | 22.5 ± 1.8 | 35.7 ± 2.9 | 0.2 ± 0.0 |
| P19 + DGAT1 + TANMEI | 25.6 ± 0.9 | 0.1 ± 0.2 | 8.5 ± 1.2 | 2.6 ± 0.5 | 21.9 ± 2.0 | 35.3 ± 3.8 | 0.2 ± 0.0 |
| P19 + DGAT1 + WUS | 24.3 ± 0.9 | 0.1 ± 0.1 | 5.5 ± 0.6 | 1.7 ± 0.2 | 16.8 ± 1.6 | 47.9 ± 3.3 | 0.2 ± 0.0 |
| P19 | 30.5 ± 1.3 | 0.0 | 8.1 ± 0.9 | 8.2 ± 6.0 | 21.8 ± 1.2 | 28.3 ± 7.3 | 0.1 ± 0.1 |
| P19 + DGAT1 + WRI1 | 25.9 ± 1.7 | 0.2 ± 0.0 | 8.3 ± 0.7 | 19.9 ± 2.8 | 24.5 ± 1.1 | 16.0 ± 0.6 | 0.8 ± 0.1 |
| P19 + DGAT1 + WRI1 + BBM | 27.7 ± 0.7 | 0.2 ± 0.0 | 6.7 ± 0.2 | 21.2 ± 0.7 | 19.8 ± 0.5 | 18.5 ± 0.6 | 0.5 ± 0.1 |
| P19 + DGAT1 + WRI1 + GFR2a1 | 29.2 ± 1.3 | 0.4 ± 0.0 | 6.1 ± 0.1 | 12.9 ± 1.5 | 24.3 ± 0.4 | 20.9 ± 0.5 | 0.4 ± 0.1 |
| P19 + DGAT1 + WRI1 + GFR2a2 | 29.9 ± 2.4 | 0.4 ± 0.1 | 5.5 ± 0.6 | 13.5 ± 2.7 | 23.0 ± 0.5 | 21.3 ± 1.2 | 0.5 ± 0.1 |
| P19 + DGAT1 + WRI1 + PHR1 | 26.2 ± 0.3 | 0.2 ± 0.0 | 4.9 ± 0.0 | 7.6 ± 0.2 | 19.2 ± 0.3 | 36.0 ± 0.7 | 0.3 ± 0.0 |
| P19 | 32.0 ± 1.9 | 1.6 ± 2.7 | 11.1 ± 2.7 | 5.5 ± 2.2 | 23.3 ± 1.1 | 25.4 ± 3.3 | 0.0 |
| P19 + DGAT1 + WRI1 | 27.5 ± 1.2 | 0.7 ± 0.8 | 6.8 ± 0.4 | 16.6 ± 2.1 | 26.7 ± 0.8 | 16.5 ± 0.3 | 1.2 ± 0.2 |
| P19 + DGAT1 + WRI1 + FUS3 | 23.6 ± 1.1 | 2.1 ± 3.5 | 6.5 ± 0.5 | 13.3 ± 0.9 | 32.1 ± 2.6 | 15.6 ± 1.5 | 1.6 ± 0.1 |

For stable transformation of plants using genes encoding the alternative transcription factors, the following binary constructs are made. The genes for expression of the transcription factors use either the SSU promoter or the SAG12 promoter. Over-expression of embryogenic transcription factors such as LEC1 and LEC2 has been shown to induce a variety of pleotropic effects, undesirable in the present context, including somatic embryogenesis (Feeney et al. (2012); Santos-Mendoza et al. (2005); Stone et al. (2008); Stone et al. (2001); Shen et al. (2010)). To minimize possible negative impact on plant development and biomass yield, tissue or developmental-stage specific promoters are preferred over constitutive promoters to drive the ectopic expression of master regulators of embryogenesis.

Example 10. Stem-Specific Expression of a Gene Encoding a Transcription Factor Leaves of *N. tabacum* plants expressing transgenes encoding WRI1, DGAT and Oleosin contain about 16% TAG at seed setting stage of development. However, the TAG levels were much lower in stems (1%) and roots (1.4%) of the plants (Vanhercke et al., 2014). The inventors considered whether the lower TAG levels in stems and roots were due to poor promoter activity of the Rubisco SSU promoter used to express the gene encoding WRI1 in the transgenic plants. The DGAT transgene in the T-DNA of pJP3502 was expressed by the CaMV35S promoter which is expressed more strongly in stems and roots and therefore was unlikely to be the limiting factor for TAG accumulation in stems and roots.

In an attempt to increase TAG biosynthesis in stem tissue, a construct was designed in which the gene encoding WRI1 was placed under the control of an *A. thaliana* SDP1 promoter. A 3.156 kb synthetic DNA fragment was synthesized comprising 1.5 kb of the *A. thaliana* SDP1 promoter (SEQ ID NO: 175) (Kelly et al., 2013), followed by the coding region for the *A. thaliana* WRI1 polypeptide and the *G. max* lectin terminator/polyadenylation region. This fragment was inserted between the SacI and NotI sites of pJP3303. The resulting vector was designated pOIL050, which was then used to transform cells from the *N. tabacum* plants homozygous for the T-DNA from pJP3502 by *Agrobacterium*-mediated transformation. Transgenic plants were selected for hygromycin resistance and a total of 86 independent transgenic plants were grown to maturity in the glasshouse. Samples were taken from transgenic leaf and stem tissue at seed setting stage and contain increased TAG levels compared to the *N. tabacum* parental plants transformed with pJP3502.

Example 11. Effect of Oil Body Protein Expression on Plant Traits

*N. tabacum* plants transformed with the T-DNA of pJP3502 and expressing transgenes encoding *A. thaliana* WRI1, DGAT1 and *S. indicum* Oleosin had increased TAG levels in vegetative tissues. As shown in Example 2 above, when the endogenous gene encoding SDP1 TAG lipase was silenced in those plants, the leaf TAG levels further increased, which indicated to the inventors that substantial TAG turnover was occurring in the plants that retained SDP1 activity. Therefore, the level of expression of the transgenes in the plants was determined. While Northern hybridisation blotting confirmed strong WRI1 and DGAT1 expression and some oleosin mRNA expression, expression analysis by digital PCR and qRT-PCR detected only very low levels of oleosin transcripts. The expression analysis revealed that the gene encoding the Oleosin was poorly expressed compared to the WRI1 and DGAT1 transgenes. From these experiments, the inventors concluded that the oil bodies in the leaf tissue were not completely protected from TAG breakdown because of inadequate production of Oleosin protein when encoded by the T-DNA in pJP3502. To improve stable accumulation of TAG throughout plant development, several pJP3502 modifications were designed in which the Oleosin gene was substituted. These modified constructs were as follows.

1. pJP3502 contains a gene (SEQ ID NO:176 provides the sequence of its complement) encoding the *S. indicum* oleosin which was poorly expressed. That gene has an internal UBQ10 intron which might be reducing the expression level. To test this, a 502 bp synthetic DNA fragment containing the *S. indicum* oleosin gene and lacking the internal UBQ10 intron was synthesized and inserted into pJP3502 as a NotI fragment, to substitute the oleosin gene containing the intron in pJP3502. The resultant plasmid was designated pOIL040.
2. The Rubisco small subunit (SSU) promoter driving expression of the oleosin gene in pJP3502 was replaced by the constitutive enTCUP2 promoter. To this end, a 232 1bp fragment containing the enTCUP2 promoter, Oleosin protein coding region, *G. max* lectin terminator/polyadenylation region and the first 643 bp of the downstream SSU promoter driving wri1 expression was synthesized and subcloned into the AscI and SpeI sites of pJP3502 resulting in pOIL038.
3. A similar strategy was followed for the expression of an engineered version of the *S. indicum* oleosin gene containing 6 introduced cysteine residues (o3-3) under the control of the enTCUP2 promoter (Winichayakul et al., 2013). A 2298 bp fragment containing the enTCUP2 promoter, Oleosin o3-3 protein coding region, *G. max* lectin terminator/polyadenylation region and the first 643 bp of the downstream SSU promoter driving wri1 expression was synthesized and subcloned into the AscI and SpeI sites of pJP3502 resulting in pOIL037.
4. The NotI sites flanking the *S. indicum* oleosin gene in pJP3502 were used to exchange the protein coding region for one encoding peanut Oleosin3 (Accession No. AAU21501.1) (Parthibane et al., 2012a; Parthibane et al., 2012b). A 528 bp fragment containing the oleosin3 gene, flanked by NotI sites, was synthesized and subcloned into the respective site of pJP3502. The resulting vector was designated pOIL041.
5. Similarly, a 1077 bp NotI flanked fragment containing the gene coding for the *A. thaliana* steroleosin (Arab-1) (Accession No. AAM10215.1) (Jolivet et al., 2014) was synthesized and subcloned into the NotI site of pJP3502, resulting in pOIL043.
6. The *Nannochloropsis* oceanic lipid droplet surface protein (LDSP) (Accession No. AFB75402.1) (Vieler et al., 2012) was synthesized as a 504 bp NotI-flanked fragment and subcloned into the NotI site of pJP3502, yielding pOIL044.
7. Finally, the *A. thaliana* caleosin (CLO3) (Accession No. 022788.1) (Shimada et al., 2014) was synthesized as a 612 bp NotI flanked fragment and subcloned into pJP3502, resulting in pOIL042.

Each of these constructs was introduced into *N. benthamiana* leaf cells as described in Example 1. Transient expression of both pJP3502 and pOIL040 in *N. benthamiana* leaf tissue resulted in elevated TAG levels and similar changes in the TAG fatty acid profile but pOIL040 increased the TAG level more (1.3% compared to 0.9%). Each of the constructs pOIL037, pOIL038, pOIL041, pOIL042 and pOIL043 were used to stably transform *N. tabacum* plants (cultivar W38) by *Agrobacterium*-mediated methods. Transgenic plants were selected on the basis of kanamycin resistance and are grown to maturity in the glasshouse. Samples are taken from transgenic leaf tissue at different stages during plant development and contain increased TAG levels compared to wild-type *N. tabacum* and *N. tabacum* plants transformed with pJP3502.

Cloning and Characterisation of LDAP Polypeptides from *Sapium sebiferum*

Oleosins are not highly expressed in non-seed oil accumulating plant tissues such as the mesocarp of olive, oil palm, and avocado (Murphy, 2012). Instead, lipid droplet associated proteins (LDAP) have been identified in these tissues that may play a similar role to that of oleosin in seed tissues (Horn et al., 2013). The inventors therefore considered it possible that oleosin might not be the optimal packaging protein to protect the accumulated oil from TAG lipase or other cytosolic enzyme activities in vegetative tissues of plants. LDAP polypeptides were therefore identified and evaluated for enhancement of TAG accumulation, as follows.

The fruit of Chinese tallow tree, *Sapium sebiferum*, a member of the family Euphorbiaceae, was of particular interest to the inventors as it contains an oil-rich tissue outside of the seed. A recent study (Divi et al, submitted for publication) indicated that this oleoginous tissue, called a tallow layer, might be derived from the mesocarp of its fruit. Therefore, the inventors queried the transcriptome of *S. sebiferum* for LDAP sequences. A comparative analysis of expressed genes in the fruit coat and seed tissues revealed a group of three previously unidentified LDAP genes which were highly expressed in the tallow layer.

Nucleotide sequences encoding the three LDAPs were obtained by RT-PCR using RNAs derived from tallow tissue using three pairs of primers. The primer sequences were based on the DNA sequences flanking the entire coding region of each of the three genes. The primer sequences were: for LDAP1, 5'-TTTTAACGATATCCGCTAAAGG-3' (SEQ ID NO: 236) and 5'-AATGAATGAACAAGAAT-TAAGTC-3' (SEQ ID NO: 237) AT-3'; LDAP2, 5'-CTTTTCTCACACCGTATCTCCG-3' (SEQ ID NO: 238) and 5'-AGCATGATATA CTTGTCGAGAAAGC-3' (SEQ ID NO: 239); LDAP3, 5'-GCGACAGTGTAGCGTTTT-3' (SEQ ID NO: 240) and 5'-ATACATAAAATGAAAACTAT-TGTGC-3' (SEQ ID NO: 241).

Analysis of the *S. sebiferum* transcriptome revealed multiple orthologs for each of the LDAP genes, including eight LDAP1, six LDAP2, and six LDAP3 genes, with less than 10% sequence divergence within each gene family. The putative peptide sequences were aligned and a phylogenetic tree was constructed using Genious software (FIG. 16), together with LDAPs homologs from other plant species, including two from avocado (Pam), one from oil palm, one from *Parthenium* argentatum (Par), two from *Arabidopsis* (Ath), five from *Taraxacum brevicorniculatum* (Tbr), three from Hevea brasihensis (Hbr), as presented in FIG. 16. The phylogenetic tree was revealed that the SsLDAP3 shared greater amino acid sequence identity to the LDAP1 and LDAP2 polypeptides from avocado and the LDAP from oil palm, while the SsLDAP1 and SsLDAP2 polypeptides were more divergent.

Genetic Constructs for Over-Expression of LDAP

In order to test the function of the LDAPs from *S. sebiferum*, expression vectors were made to express each of these polypeptides under the control of the 35S promoter in leaf cells. The full length SsLDAP cDNA sequences were inserted into the pDONR207 destination vector by recombination reactions, replacing the CcdB and Cm(R) regions of the destination vector with the SsLDAP cDNA fragments. Following confirmation by restriction digestion analysis and DNA sequencing, the constructs were introduced into *Agrobacterium tumefaciens* strain AGL1 and used for both transient expression in *N. benthamiana* leaf cells and stable transformation of *N. tabacum*.

The expression of each of the three SsLDAP genes under the transcriptional control of the 35S promoter in *N. benthamiana* leaves in combination with the expression of 35S::AtDGAT1 and 35S::AtWRI1 yielded substantially higher levels of TAG accumulation relative to the cells infiltrated with the 35S::AtDGAT1 and 35S::AtWRI1 genes without the LDAP construct. The TAG level was increased about 2-fold above the TAG level in the control cells. A significant increase in the level of α-linolenic acid (ALA)

and a reduced level of saturated fatty acids was observed in the cells receiving the combination of genes, relative to the control cells.

Co-Localisation of YFP Fused LDAP Polypeptides with Lipid Droplets in Leaf Cells In order to characterise SsLDAPs in vivo and observe their dynamic behaviour, expression constructs were made for expression of fusion polypeptides consisting of the LDAP polypeptides fused to yellow fluorescent protein (YFP). For each fusion polypeptide, the YFP was fused in-frame to the C-terminus of the SsLDAP. The full open reading frame of each of the three LDAP genes without a stop codon, at its 3' end, was fused to the YFP sequence and the chimeric genes inserted into pDONR207. Following confirmation of the resultant constructs by restriction digestion and DNA sequencing, the constructs were introduced into A. tumefaciens strain AGL1 and used for both transient expression in N. benthamiana leaf cells and stable transformation of N. tabacum. Three days following infiltration of the leaf cells with the LDAP-YFP constructs, leaf discs from the infiltrated zones were stained with Nile Red, which positively stained lipid droplets, and observed under a confocal microscope to detect both the red stain (lipid droplets) and fluorescence from the YFP polypeptide. Co-localisation of LDAP-YFP with the lipid droplets was observed, indicating that the LDAP associated with the lipid droplets in the leaf cells.

Example 12. Silencing of TGD Genes in Plants

Li-Beisson et al. (2013) estimated that in Arabidopsis leaves (a 16:3 plant), approximately 40% of the fatty acids synthesized in chloroplasts enter the prokaryotic pathway, whereas 60% were exported to enter the eukaryotic pathway. After they were desaturated in the ER, about half of these exported fatty acids are returned to the plastid to support galactolipid synthesis for thylakoid membranes. The transport (import) of the fatty acids as DAG or phospholipids into the plastid involves TGD1, a permease-like protein of the inner chloroplast envelope. The Arabidopsis ABC lipid transporter comprising TGD1, 2, and 3 proteins was identified by Benning et al. (2008 and 2009) and more recently by Roston et al. (2012). This protein complex is localized in the inner chloroplast envelope membrane and is proposed to mediate the transfer of phosphatidate across this membrane. TGD2 polypeptide is a phosphatidic-binding protein, and TGD3 an ATPase. A novel Arabidopsis protein, TGD4, was identified by a genetic approach (Xu et al., 2008) and inactivation of the TGD4 gene also blocked lipid transfer from the ER to plastids. Recent biochemical data indicate that TGD4 is phosphatidate binding protein residing in the outer chloroplast envelope membrane (Wang and Benning, 2012).

Xu et al. (2005) described leaky tgd1 alleles in A. thaliana resulting in reduced plant growth and high occurrence of embryo abortion. Leaf tissue of A. thaliana tgd1 mutants contained increased TAG levels, likely as cytosol oil droplets. In addition, elevated TAG levels were also found in roots of tgd1 mutants. No difference in seed oil content was detected. Similar TAG accumulation in leaf tissue has been reported for A. thaliana tgd2 (Awai et al., 2006), tgd3 (Lu et al., 2007) and tgd4 mutants (Xu et al., 2008). All tgd mutant alleles were either sufficiently leaky or severely impairing in plant development.

TGD1 Silencing

A silencing construct directed against the TGD1 plastidial importer was generated based on a full length mRNA transcript identified in the N. benthamiana transcriptome. A 685 bp fragment was amplified from N. benthamiana leaf cDNA while incorporating a PmlI site at the 5' end. The TGD1 fragment was first cloned into pENTR/D-TOPO (Invitrogen) and subsequently inserted into the pHELLS-GATE12 destination vector via LR cloning (Gateway). The resulting expression vector was designated pOIL025 and is transiently expressed in N. benthamiana to assess the effect of TGD1 gene silencing on leaf TAG levels. The TGD1 hairpin construct is placed under the control of the A. niger inducible alcA promotor by subcloning as a PmlI-EcoRV fragment into the NheI (klenow)-SfoI sites of pOIL020 (below). The resulting vector, designated pOIL026, is super-transformed into a homozygous N. tabacum pJP3502 line to further increase leaf oil levels.

Further constructs are made for expressing hairpin RNA for reducing expression of the TGD-2, -3, -4 and -5 genes. Transformed plants are produced using these constructs and oil content determined in the transformants. The transformed plants are crossed with the transformants generated with pJP3502 or other combinations of genes as described above.

Example 13. Expression of Gene Combinations in Potato Tubers

Construction of pJP3506

A genetic construct containing three genes for expression in potato tubers was made and used for potato transformation. This construct was designated as pJP3506 and was based on an existing vector pJP3502 (WO2013/096993) with replacement of promoters to provide for tuber-specific expression. pJP3506 contained (i) an NPTII kanamycin resistance gene driven by 35S promoter with duplicated enhancer region (e35S) as the selectable marker gene and three gene expression cassettes, which were (ii) 35S::AtD-GAT1 encoding the Arabidopsis thaliana DGAT1, (iii) B33::AtWRI1 encoding the Arabidopsis thaliana WRI1, and (iv) B33::sesame oleosin, encoding the oleosin from Sesame indicum. The nucleotide sequences encoding these polypeptides were as in pJP3502. The patatin B33 promoter (B33) was a tuber specific promoter derived from Solanum tuberosum, which was provided by Dr Alisdair Fernie, Max Planck Institute of Molecular Plant Physiology, Potsdam, Germany. A circular plasmid map of pJP3506 is presented in FIG. 17.

The S. tuberosum Patatin B33 promoter sequence used in the pJP3506 construct was a truncated version having 183 nucleotides deleted from the 5' end and 261 nucleotides deleted from the 3' end relative to GenBank Accession No. X14483. The nucleotide sequence of the patatin B33 promoter as used in pJP3506 is given as SEQ ID NO: 202.

Transformation of Potato

Potato seedlings (Solanum tuberosum) of cultivar Atlantic which had been grown aseptically in tissue culture were purchased from Toolangi Elite, Victorian Certified Seed Potato Authority (ViCSPA), Victoria, Australia. Stem internodes were excised into pieces of approximately 1 cm in length under a suspension of Agrobacterium tumefaciens strain LBA4404 containing pJP3506. The Agrobacterium cells had been grown to an OD of 0.2 and diluted with an equal volume MS medium. Excess Agrobacterium suspension was removed by brief blotting the stem pieces on sterile filter paper, which were then plated onto MS medium and maintained at 24° C. for two days (co-cultivation). The internodes were then transferred onto fresh MS medium supplemented with 200 µg/L NAA, 2 mg/L BAP and 250 mg/L Cefetaxime. Selection of transgenic calli was initiated 10 days later when the internodes were transferred onto fresh MS medium supplemented with 2 mg/L BAP, 5 mg/L GA3, 50 mg/L kanamycin and 250 mg/L Cefetaxime. Shoots regenerated from calli were excised and placed onto plain MS medium for root induction prior to transplanting into a 15 cm diameter pot containing potting mix and grown in the greenhouse until plant maturity including tuber growth.

DNA Extraction and Molecular Identification of the Transgenic Plants by PCR

Disks of about 1 cm in diameter were obtained from potato leaves from the plants in the greenhouse. These were placed in a deep-well microtiter plate and freeze dried for 48 hr. The freeze dried leaf samples were then ground into powder by adding a steel ball bearing to each well and shaking the plate in a Reicht tissue lyser (Qiagen) at a maximum frequency of 28/sec for 2 min each side of the microtiter plate. 375 µL of extraction buffer containing 0.1 M Tris-HCl pH8.0, 0.05 M EDTA and 1.25% SDS was added to each well containing the powdered leaf tissue. Following 1 hr incubation at 65° C., 187 µL of 6M ammonium acetate was added to each well and the mixtures stored at 4° C. for 30 min prior to centrifugation of the plates for 30 min at 3000 rpm. 340 µL supernatant from each well was transferred into a new deep well microtiter plate containing 220 µL isopropanol and maintained for 5 min at room temperature prior to centrifugation at 3000 rpm for 30 min. The precipitated DNA pellets were washed with 70% ethanol, air dried and resuspended in 225 µL $H_2O$ per sample.

Two µL from each leaf sample DNA preparation was added to a 20 µL PCR reaction mix using the HotStar PCR system (Qiagen). A pair of oligonucleotide primers based on 5' and 3' sequences from the *Arabidopsis thaliana* WRI1 gene, codon-optimized for tobacco, was used in the PCR reactions. Their sequences were: Nt-Wri-P3: 5'-CACTCGTGCTTTCCATCATC-3' (SEQ ID NO: 203) and Nt-Wri-P1: 5'-GAAGGCTGAGCAACAAGAGG-3' (SEQ ID NO: 204). A pair of oligonucleotide primers based on the *Arabidopsis thaliana* DGAT1 gene, codon-optimized for tobacco, was also used in a separate PCR reaction on each DNA sample. Their sequences were: Nt-DGAT-P2: 5'-GGCGATTTTGGATTCTGC-3' (SEQ ID NO: 205) and Nt-DGAT-P3: 5'-CCCAACCCTTCCGTATACAT-3' (SEQ ID NO: 206). Amplification was carried out with an initial cycle at 95° C. for 15 min, followed by 40 cycles of 95° C. for 30 sec, 57° C. for 30 sec and 72° C. for 60 sec. The PCR products were electrophoresed on a 1% agarose gel to detect specific amplification products.

Lipid Analysis of Potato Tubers

Thin slices of tubers harvested from regenerated potato plants, for confirmed transgenic plants and non-transformed controls, were freeze-dried for 72 hr and analysed for lipid content and composition. Total lipids were extracted from the dried tuber tissues using chloroform:methanol:0.1 M KCl (2:1:1 v/v/v) as follows. The freeze-dried tuber tissues were first homogenized in chloroform:methanol (2:1, v/v) in an eppendorf tube containing a metallic ball using a Reicht tissue lyser (Qiagen) for 3 min at a frequency of 29 per sec. After mixing each homogenate with a Vibramax 10 (Heidolph) at 2,000 rpm for 15 min, 1/3 volume of 0.1 M KCl solution was added to each sample and mixed further. Following centrifugation at 10,000 g for 5 min, the lower phase containing lipids from each sample was collected and evaporated completely using $N_2$ flow. Each lipid preparation was dissolved in 3 µL of $CHCl_3$ per milligram of tuber dry weight. Aliquots of the lipid preparations were loaded on a thin layer chromatography (TLC) plate (20 cm×20 cm, Silica gel 60, Merck) and developed in hexane:diethyl ether:acetic acid (70:30:1, v/v/v). The TLC plate was sprayed with Primuline and visualized under UV to show lipid spots. TAG and PL were recovered by scraping the silica of the appropriate bands and converted to fatty acid methyl esters (FAME) by incubating the material in 1 N methanolic-HCl (Supelco, Bellefonte, Pa.) at 80° C. for 2 hr together with known amount of Triheptadecanoin (Nu-Chek PREP, Inc. USA) as internal standard for lipid quantification. FAME were analysed by GC-FID (7890A GC, Agilent Technologies, Palo Alto, Calif.) equipped with a 30 m BPX70 column (0.25 mm inner diameter, 0.25 mm film thickness, SGE, Austin, USA) as described previously (Petrie et al., 2012). Peaks were integrated with Agilent Technologies Chem Station software (Rev B.04.03).

Among the approximately 100 individual transgenic lines regenerated, analysis of lipids derived from young potato tubers of about 2 cm in diameter revealed increased levels in total lipids, TAG and phospholipids fractions in tubers from many of the transgenic plants, with a range observed between no increase to substantial increases. The first analysis of the potato tuber lipids indicated that a typical wild-type potato tuber at its early stage of development (about 2 cm in diameter) contained about the 0.03% TAG on dry weight basis.

The content of total lipids was increased to 0.5-4.7% by weight (dry weight) in tubers of 21 individual transgenic plants, representing 16 independently transformed lines (Table 29). Tubers of line #69 showed the highest TAG accumulation at an average 3.3% on dry weight basis. This was approximately a 100-fold increase relative to the wild-type tubers at the same developmental stage. Tubers of the same transgenic line also accumulated the highest observed levels of phospholipids at 1.0% by weight in the young tubers on a dry weight basis (Table 30). The enhanced lipid accumulation was also accompanied by an altered fatty acid composition in transgenic tubers. The transgenic tubers consistently accumulated higher percentages of saturated and monounsaturated fatty acids (MUFA) and lower level of polyunsaturated fatty acids (PUFA) in both the total fatty acid content and in the TAG fraction of the total fatty acid content (Table 29), particularly a reduced level of 18:3 (ALA) which was reduced from about 17% in the wild-type to less than 10% in the transgenic tubers. The level of oleic acid (18:1) in the total fatty acid content increased from about 1% in the wild-type to more than 5% in many of the lines and more than 15% in some of the tubers. Although palmitic acid levels were increased, the stearic acid (18:0) levels decreased in the best transgenic lines (Tables 28 and 29).

TABLE 28

Total lipid yield (% weight of potato tuber dry weight) and its fatty acid composition in representative young potato tubers transformed with the T-DNA of pJP3506, prior to flowering of the plants. Tubers of line 65 were equivalent to the wild-type (non-transgenic) tubers.

| Sample | C14:0 | C16:0 | C16:1 | C16:3 | C18:0 | C18:1 | C18:1d11 | C18:2 | C18:3 | C20:0 | C20:1 | C22:0 | C24:0 | % TFA |
|---|---|---|---|---|---|---|---|---|---|---|---|---|---|---|
| 4-2 | 0.2 | 16.1 | 0.2 | 0.0 | 5.8 | 0.5 | 11.7 | 55.5 | 5.5 | 2.1 | 0.2 | 0.6 | 1.5 | 1.4 |
| 19 | 0.2 | 18.1 | 0.2 | 0.0 | 5.8 | 0.4 | 12.9 | 52.2 | 5.9 | 2.0 | 0.2 | 0.7 | 1.5 | 1.5 |
| 27-2 | 0.2 | 18.9 | 0.3 | 0.0 | 6.5 | 0.5 | 5.5 | 55.0 | 8.0 | 2.0 | 0.2 | 0.8 | 2.1 | 0.7 |
| 27-4 | 0.2 | 19.0 | 0.3 | 0.0 | 6.5 | 5.4 | 0.5 | 57.0 | 7.9 | 1.6 | 0.0 | 0.5 | 1.1 | 0.6 |
| 27-5 | 0.2 | 17.8 | 0.6 | 0.0 | 6.4 | 2.2 | 0.4 | 57.6 | 11.7 | 1.5 | 0.0 | 0.4 | 1.2 | 0.7 |
| 27-6 | 0.2 | 18.7 | 0.4 | 0.0 | 6.9 | 6.3 | 0.5 | 55.9 | 8.2 | 1.6 | 0.0 | 0.4 | 0.9 | 0.8 |
| 55 | 0.2 | 17.8 | 0.6 | 0.0 | 6.4 | 7.9 | 0.5 | 55.7 | 8.6 | 1.4 | 0.0 | 0.3 | 0.7 | 1.0 |
| 65 | 0.2 | 19.4 | 0.4 | 0.0 | 5.7 | 1.2 | 0.5 | 53.6 | 17.2 | 0.9 | 0.0 | 0.0 | 1.0 | 0.5 |
| 69 | 0.3 | 19.8 | 0.1 | 0.0 | 3.2 | 16.5 | 0.9 | 53.2 | 3.7 | 1.1 | 0.3 | 0.4 | 0.6 | 4.7 |
| 78 | 0.2 | 19.5 | 0.5 | 0.0 | 5.3 | 4.9 | 0.5 | 54.7 | 11.7 | 1.2 | 0.0 | 0.4 | 1.0 | 0.9 |
| 83 | 0.2 | 16.7 | 0.4 | 0.0 | 6.5 | 7.3 | 0.5 | 56.2 | 8.5 | 1.7 | 0.6 | 0.5 | 0.9 | 1.3 |
| 95-1 | 0.3 | 21.0 | 0.2 | 0.1 | 3.1 | 15.2 | 0.8 | 52.8 | 4.2 | 1.1 | 0.2 | 0.3 | 0.7 | 3.0 |
| 95-2 | 0.4 | 21.3 | 0.3 | 0.1 | 4.1 | 7.1 | 1.0 | 56.1 | 7.3 | 1.2 | 0.2 | 0.3 | 0.7 | 2.7 |
| 95-3 | 0.4 | 21.4 | 0.3 | 0.0 | 4.3 | 8.5 | 0.9 | 54.5 | 7.4 | 1.3 | 0.0 | 0.3 | 0.7 | 1.5 |
| 100 | 0.4 | 19.0 | 0.5 | 0.0 | 5.4 | 7.6 | 0.8 | 55.5 | 7.3 | 1.4 | 0.5 | 0.5 | 0.9 | 1.0 |
| 104 | 0.2 | 18.0 | 0.2 | 0.0 | 6.1 | 0.5 | 6.8 | 56.1 | 7.6 | 2.3 | 0.1 | 0.6 | 1.5 | 0.9 |
| 106 | 0.2 | 19.7 | 0.2 | 0.1 | 4.6 | 0.9 | 10.7 | 54.1 | 5.7 | 1.7 | 0.1 | 0.6 | 1.3 | 1.3 |

TABLE 29

TAG yield (% weight of potato tuber dry weight) and its fatty acid composition in representative young potato tubers, transformed with the T-DNA of pJP3506, prior to flowering of the plants.

| Sample | C14:0 | C16:0 | C16:1 | C16:3 | C18:0 | C18:1 | C18:1d11 | C18:2 | C18:3 | C20:0 | C20:1 | C22:0 | C24:0 | % TAG |
|---|---|---|---|---|---|---|---|---|---|---|---|---|---|---|
| WT | 0.4 | 13.4 | 0.0 | 0.0 | 4.6 | 5.5 | 0.5 | 59.9 | 15.7 | 0.0 | 0.0 | 0.0 | 0.0 | 0.03 |
| 4-2 | 0.3 | 15.4 | 0.2 | 0.0 | 7.0 | 0.6 | 16.4 | 52.5 | 3.1 | 2.6 | 0.2 | 0.6 | 1.1 | 0.5 |
| 19 | 0.2 | 16.3 | 0.1 | 0.0 | 7.2 | 18.0 | 0.5 | 50.9 | 3.6 | 1.9 | 0.2 | 0.4 | 0.6 | 0.8 |
| 27-2 | 0.0 | 19.0 | 0.0 | 0.0 | 11.2 | 9.8 | 0.0 | 52.8 | 4.4 | 2.8 | 0.0 | 0.0 | 0.0 | 0.2 |
| 27-4 | 0.4 | 17.4 | 0.0 | 0.0 | 10.2 | 9.4 | 0.0 | 55.4 | 4.7 | 2.6 | 0.0 | 0.0 | 0.0 | 0.2 |
| 27-5 | 0.0 | 17.9 | 0.0 | 0.0 | 12.5 | 4.4 | 0.0 | 54.9 | 7.1 | 3.2 | 0.0 | 0.0 | 0.0 | 0.1 |
| 27-6 | 0.0 | 17.1 | 0.0 | 0.0 | 9.9 | 10.6 | 0.0 | 55.0 | 4.9 | 2.5 | 0.0 | 0.0 | 0.0 | 0.2 |
| 55 | 0.3 | 17.6 | 0.5 | 0.0 | 8.5 | 12.5 | 0.6 | 52.5 | 5.2 | 1.9 | 0.0 | 0.0 | 0.6 | 0.5 |
| 65 | 0.0 | 18.1 | 0.0 | 0.0 | 12.0 | 0.0 | 0.0 | 55.6 | 14.4 | 0.0 | 0.0 | 0.0 | 0.0 | 0.0 |
| 69 | 0.3 | 20.1 | 0.6 | 0.0 | 3.8 | 20.3 | 1.0 | 49.4 | 2.2 | 1.3 | 0.2 | 0.3 | 0.5 | 3.3 |
| 78 | 0.0 | 19.1 | 0.0 | 0.0 | 8.2 | 9.4 | 0.0 | 52.5 | 8.4 | 2.4 | 0.0 | 0.0 | 0.0 | 0.2 |
| 83 | 0.3 | 16.4 | 0.2 | 0.0 | 8.7 | 11.1 | 0.6 | 53.4 | 5.4 | 2.6 | 0.0 | 0.5 | 0.7 | 0.5 |
| 95-1 | 0.3 | 21.7 | 0.4 | 0.1 | 3.6 | 18.5 | 1.0 | 50.1 | 2.8 | 0.9 | 0.2 | 0.2 | 0.3 | 2.2 |
| 95-2 | 0.6 | 23.4 | 0.4 | 0.0 | 5.1 | 10.1 | 1.2 | 51.9 | 5.3 | 1.4 | 0.0 | 0.0 | 0.5 | 0.9 |
| 95-3 | 0.3 | 17.2 | 0.3 | 0.0 | 7.7 | 0.6 | 11.6 | 49.7 | 8.9 | 2.5 | 0.0 | 0.0 | 1.1 | 0.1 |
| 100 | 0.0 | 18.8 | 0.5 | 0.0 | 8.0 | 12.0 | 0.8 | 54.0 | 3.9 | 2.0 | 0.0 | 0.0 | 0.0 | 0.4 |
| 104 | 0.3 | 17.7 | 0.0 | 0.0 | 8.4 | 0.6 | 11.0 | 52.1 | 4.7 | 3.2 | 0.0 | 0.7 | 1.3 | 0.3 |
| 106 | 0.4 | 20.1 | 0.3 | 0.0 | 5.4 | 15.5 | 1.1 | 51.8 | 3.6 | 1.4 | 0.0 | 0.0 | 0.4 | 0.7 |

TABLE 30

Phospholipids yield (% weight of potato tuber dry weight) and its fatty acid composition in representative young potato tubers, transformed with the T-DNA of pJP3506, prior to flowering.

| Sample | C14:0 | C16:0 | C16:1 | C16:3 | C18:0 | C18:1 | C18:1d11 | C18:2 | C18:3 | C20:0 | C20:1 | C22:0 | C24:0 | % PL |
|---|---|---|---|---|---|---|---|---|---|---|---|---|---|---|
| 4-2 | 0.2 | 21.2 | 0.2 | 0.0 | 4.6 | 0.4 | 3.8 | 57.8 | 9.3 | 0.9 | 0.0 | 0.0 | 1.7 | 0.3 |
| 19 | 0.1 | 22.7 | 0.2 | 0.0 | 4.4 | 5.1 | 0.3 | 54.9 | 8.9 | 0.7 | 1.0 | 0.5 | 1.2 | 0.4 |
| 27-2 | 0.2 | 21.0 | 0.3 | 0.0 | 5.2 | 2.8 | 0.4 | 56.9 | 9.3 | 0.9 | 1.3 | 0.4 | 1.4 | 0.4 |
| 27-4 | 0.0 | 22.9 | 0.0 | 0.0 | 6.0 | 2.3 | 0.0 | 57.2 | 8.8 | 1.1 | 0.0 | 0.0 | 1.6 | 0.3 |
| 27-5 | 0.0 | 19.6 | 0.5 | 0.0 | 5.0 | 1.2 | 0.0 | 58.7 | 12.6 | 1.0 | 0.0 | 0.0 | 1.4 | 0.4 |
| 27-6 | 0.0 | 22.9 | 0.0 | 0.0 | 6.3 | 2.6 | 0.0 | 56.3 | 9.3 | 1.2 | 0.0 | 0.0 | 1.5 | 0.3 |
| 55 | 0.1 | 21.2 | 0.4 | 0.0 | 5.1 | 2.1 | 0.0 | 57.8 | 11.4 | 0.7 | 0.0 | 0.0 | 1.0 | 0.4 |
| 65 | 0.0 | 21.4 | 0.4 | 0.0 | 5.9 | 1.1 | 0.0 | 53.2 | 15.7 | 1.1 | 0.0 | 0.0 | 1.3 | 0.3 |
| 69 | 0.2 | 21.5 | 0.2 | 0.0 | 2.3 | 3.7 | 0.6 | 61.9 | 7.9 | 0.6 | 0.0 | 0.4 | 0.8 | 1.0 |
| 78 | 0.0 | 22.1 | 0.4 | 0.0 | 4.4 | 2.7 | 0.4 | 55.6 | 12.2 | 0.8 | 0.0 | 0.0 | 1.3 | 0.4 |
| 83 | 0.2 | 21.1 | 0.3 | 0.0 | 5.0 | 2.9 | 0.4 | 57.1 | 10.7 | 0.8 | 0.0 | 0.4 | 1.1 | 0.5 |
| 95-1 | 0.2 | 24.8 | 0.5 | 0.0 | 2.6 | 3.5 | 0.6 | 59.1 | 7.6 | 0.6 | 0.0 | 0.0 | 0.6 | 0.6 |
| 95-2 | 0.3 | 22.1 | 0.0 | 0.0 | 2.7 | 2.1 | 0.6 | 61.0 | 9.6 | 0.7 | 0.0 | 0.0 | 0.9 | 0.6 |
| 95-3 | 0.2 | 23.2 | 0.5 | 0.0 | 3.1 | 3.6 | 0.7 | 57.7 | 9.3 | 0.7 | 0.0 | 0.0 | 0.9 | 0.5 |

TABLE 30-continued

Phospholipids yield (% weight of potato tuber dry weight) and its fatty acid composition in representative young potato tubers, transformed with the T-DNA of pJP3506, prior to flowering.

| Sample | C14:0 | C16:0 | C16:1 | C16:3 | C18:0 | C18:1 | C18:1d11 | C18:2 | C18:3 | C20:0 | C20:1 | C22:0 | C24:0 | % PL |
|---|---|---|---|---|---|---|---|---|---|---|---|---|---|---|
| 100 | 0.0 | 23.3 | 0.5 | 0.0 | 4.6 | 3.0 | 0.4 | 57.2 | 9.0 | 0.8 | 0.0 | 0.0 | 1.1 | 0.4 |
| 104 | 0.0 | 21.3 | 0.0 | 0.0 | 4.8 | 2.7 | 0.0 | 58.3 | 10.1 | 1.0 | 0.0 | 0.0 | 1.7 | 0.4 |
| 106 | 0.2 | 23.2 | 0.2 | 0.0 | 3.8 | 3.0 | 0.6 | 57.1 | 8.6 | 0.7 | 1.0 | 0.4 | 1.1 | 0.4 |

The transgenic potato plants were maintained in the glasshouse to allow for continued growth of the tubers. Larger tubers of line #69 contained greater levels of TFA and TAG than the tubers of about 2 cm in diameter.

Further increased levels of TFA and TAG are obtained in potato tubers by addition of a chimeric gene that encodes a silencing RNA for down-regulating the expression of the endogenous SDP1 gene, in combination with the WRI1 and DGAT genes.

Further Gene Combinations for Transformation of Potato

Total RNA from fresh developing potato (*Solanum tuberosum* L. cv. Atlantic) tubers was extracted by the TRIzol method (Invitrogen). Selected regions of the cDNAs encoding potato AGPase small subunit and SDP1 were obtained through RT-PCR using the following primers: st-AGPs1: 5'-ACAGACATGTCTAGACCCAGATG-3' (SEQ ID NO: 242), st-AGPa1: 5'-CACTCTCATCC-CAAGTGAAGTTGC-3' (SEQ ID NO: 243); st-SDP1-s1: 5'-CTGAGATGGAAGTGAAGCACAGATG-3' (SEQ ID NO: 244), and st-SDP1-a1: 5'-CCATTGT-TAGTCCTTTCAGTC-3' (SEQ ID NO: 245). The PCR products were then purified and ligated to pGEMT Easy.

Following verification by DNA sequencing, the cloned PCR products were either directly used as the target gene sequence to make a hairpin RNAi construct or fused by overlapping PCR. Three PCR fragments (SDP1, AGPase, SDP+AGP) were subsequently cloned into the pKannibal vector that contained specific restriction sites to clone the desired fragment in sense and antisense orientation. The restriction sites selected were BamHI and HindIII for cloning the fragment in the sense orientation and KpnI and XhoI for inserting the fragment in the antisense orientation. Primers sets used for amplification of the three target gene fragments were altered by addition of restriction sites which direct the fragment into cloning sites of pKannibal. The expression cassettes containing the target DNA fragment between the 35S promoter and OCS terminator in pKannibal were released with NotI and cloned into a binary vector pWBVec2 with hygromycin as the plant selectable marker. Such binary vectors were introduced into *A. tumefaciens* AGL1 strain and used for potato transformation as described above.

Example 14. Modifying Traits in Monocotyledonous Plants

Expression in Endosperm

The oil content in the endosperm of the monocotyledonous plant species *Triticum aestivum* (wheat) and therefore in the grain of the plants was increased by expressing a combination of genes encoding WRI1, DGAT and Oleosin in the endosperm during grain development using endosperm-specific promoters. The construct (designated pOIL-Endo2) contained the chimeric genes: (a) the promoter of the Glu1 gene of *Brachypodium distachyon*::protein coding region of the *Zea mays* gene encoding the ZmWRI1 polypeptide (SEQ ID NO:35)::terminator/polyadenylation region from the *Glycine max* lectin gene, (b) the promoter of the Bx17 glutenin gene of *Triticum aestivum*::protein coding region of the *A. thaliana* gene encoding the AtDGAT1 polypeptide (SEQ ID NO:1)::terminator/polyadenylation region from the *Agrobacterium tumefaciens* Nos gene, (c) the promoter of the GluB4 gene of *Oryza sativa*::protein coding region of the *Sesame indicum* gene encoding the Oleosin polypeptide:terminator/polyadenylation region from the *Glycine max* lectin gene and (d) a 35S promoter:: hygromycin resistance coding region as a selectable marker gene. The construct was used to transform immature embryos of *T. aestivum* (cv. Fielder) by Agrobacterium-mediated transformation. The inoculated immature embryos were exposed to hygromycin to select transformed shoots and then transferred to rooting medium to form roots, before transfer to soil.

Thirty transformed plants were obtained which set T1 seed and contained the T-DNA from pOIL-Endo2. Mature seeds were harvested from all 30 plants, and 6 seed of each family cut in half. The halves containing the embryo were stored for later germination; the other half containing mainly endosperm was extracted and tested for oil content. The T-DNA inserted into the wheat genome was still segregating in the T1 seeds from these plants, so the T1 seeds were a mixture of homozygous transformed, heterozygous transformed and nulls for the T-DNA. Increased oil content was observed in the endosperm of some of the grains, with some grains showing greater than a 5-fold increase in TAG levels. The endosperm halves of six wild-type grains (cv. Fielder) had a TAG content of about 0.47% by weight (range 0.37% to 0.60%), compared to a TAG content of 2.5% in some grains. Some families had all six grains with TAG in excess of 1.7%; others were evidently segregating with both wild type and elevated content of TAG. In endosperms with elevated TAG content the fatty acid composition was also altered, showing increases in the percentages of oleic acid and palmitic acid, and a decrease in the percentage of linoleic acid (Table 31). The T1 grain germinated without difficulty at the same rate as the corresponding wild-type grain and plants representing both high oil and low oil individuals from 14 T0 families were grown to maturity. These plants were fully male and female fertile.

TABLE 31

Fatty acid composition (% of total fatty acids) of TAG content and the total TAG content (% oil by weight of half endosperms) in transgenic wheat endosperm

| Sample | C14:0 | C16:0 | C16:1 | C16:3 | C18:0 | C18:1 | C18:1d11 |
|---|---|---|---|---|---|---|---|
| Control 1 | 0.3 | 16.9 | 0.1 | 0.0 | 1.6 | 15.6 | 0.6 |
| Control 2 | 0.3 | 16.0 | 0.1 | 0.1 | 1.6 | 15.1 | 0.6 |
| F5.3 | 0.1 | 20.1 | 0.1 | 0.1 | 2.6 | 23.5 | 0.6 |
| F16.3 | 0.1 | 19.1 | 0.1 | 0.1 | 2.8 | 24.2 | 0.6 |

% oil by

TABLE 31-continued

Fatty acid composition (% of total fatty acids) of TAG content and the total TAG content (% oil by weight of half endosperms) in transgenic wheat endosperm

| Sample | C18:2 | C18:3n3 | C20:0 | C20:1 | C22:0 | C24:0 | wt. |
|---|---|---|---|---|---|---|---|
| Control 1 | 60.4 | 4.0 | 0.1 | 0.4 | 0.0 | 0.0 | 0.5 |
| Control 2 | 61.3 | 4.3 | 0.1 | 0.3 | 0.0 | 0.0 | 0.49 |
| F5.3 | 48.5 | 2.4 | 0.8 | 0.7 | 0.3 | 0.4 | 2.5 |
| F16.3 | 48.1 | 2.9 | 0.7 | 0.5 | 0.3 | 0.4 | 1.8 |

220 T2 seed from 22 selected T1 plants were analysed, plus 40 plants from 3 different parental Fielder plants. In most cases ten T2 seed from each T1 plant were tested. Some of the selected T1 plants were nulls with wild type endosperm TAG levels. Some of the results for endosperm half seed analyses are represented in FIG. 18. The high endosperm oil T1 plants produced T2 grain many of which had increased endosperm oil, whereas the control Fielder and null segregant T1 plants produced grain with similar levels of endosperm oil (total fatty acid, TFA).

The grain is useful for preparing food products for human consumption or as animal feed, providing grain with an increased energy content per unit weight (energy density) and resulting in increased growth rates in the animals such as, for example, poultry, pigs, cattle, sheep and horses.

The construct pOIL-Endo2 is also used to transform corn (*Zea mays*) and rice (*Oryza sativa*) to obtain transgenic plants which have increased TAG content in endosperm and therefore in grain.

Expression in Leaves and Stems

A series of binary expression vectors was designed for *Agrobacterium*-mediated transformation of sorghum (*S. bicolor*) and wheat (*Triticum aestivum*) to increase the oil content in vegetative tissues. The starting vectors for the constructions were pOIL093-095, pOIL134 and pOIL100-104 (see Example 5). Firstly, a DNA fragment encoding the *Z. mays* WRI1 polypeptide was amplified by PCR using pOIL104 as a template and primers containing KpnI restriction sites. This fragment was subcloned downstream of the constitutive *Oryza sativa* Actin1 promoter of pOIL095, using the KpnI site. The resulting vector was designated pOIL154. The DNA fragment encoding the *Umbelopsis ramanniana* DGAT2a under the control of the *Z. mays* ubiquitin promoter (pZmUbi) was isolated from pOIL134 as a NotI fragment and inserted into the NotI site of pOIL154, resulting in pOIL155. An expression cassette consisting of the PAT coding region under the control of the pZmUbi promoter and flanked at the 3' end by the *A. tumefaciens* NOS terminator/polyadenylation region was constructed by amplifying the PAT coding region using pJP3416 as a template. Primers were designed to incorporate BamHI and SacI restriction sites at the 5' and 3' ends, respectively. After BamHI+SacI double digestion, the PAT fragment was cloned into the respective sites of pZLUbi 1 casNK. The resulting intermediate was designated pOIL141. Next, the PAT selectable marker cassette was introduced into the pOIL155 backbone. To this end, pOIL141 was first cut with NotI, blunted with Klenow fragment of DNA polymerase I and subsequently digested with AscI. This 2622 bp fragment was then subcloned into the ZraI-AscI sites of pOIL155, resulting in pOIL156. Finally, the Actin1 promoter driving WRI1 expression in pOIL156 was exchanged for the *Z. mays* Rubisco small subunit promoter (pZmSSU) resulting in pOIL157. This vector was obtained by PCR amplification of the *Z. mays* SSU promoter using pOIL104 as a template and flanking primers containing AsiSI and PmlI restriction sites. The resulting amplicon was then cut with SpeI+MluI and subcloned into the respective sites of pOIL156.

These vectors therefore contained the following expression cassettes:

pOIL156: promoter *O. sativa* Actin1::*Z. mays* WRI1, promoter *Z. mays* Ubiquitin::*U. rammaniana* DGAT2a and promoter *Z. mays* Ubiquitin::PAT pOIL157: promoter *Z. mays* SSU::*Z. mays* WRI1, promoter *Z. mays* Ubiquitin::*U. rammaniana* DGAT2a and *Z. mays* Ubiquitin::PAT.

A second series of binary expression vectors containing the *Z. mays* SEE1 senescence promoter (Robson et al., 2004, see Example 5), *Z. mays* LEC1 transcription factor (Shen et al., 2010) and a *S. bicolor* SDP1 hpRNAi fragment were constructed as follows. First, a matrix attachment region (MAR) was introduced into pORE04 by AatII+SnaBI digest of pDCOT and subcloning into the AatII+EcoRV sites of pORE04. The resulting intermediate vector was designated pOIL158. Next, the PAT selectable marker gene under the control of the *Z. mays* Ubiquitin promoter was subcloned into pOIL158. To this end, pOIL141 was first digested with NotI, treated with Klenow fragment of DNA polymerase I and finally digested with AscI. The resulting fragment was inserted into the AscI+ZraI sites of pOIL158, resulting in pOIL159. The original RK2 oriV origin of replication in pOIL159 was exchanged for the RiA4 origin by SwaI+SpeI restriction digestion of pJP3416, followed by subcloning into the SwaI+AvrII sites of pOIL159. The resulting vector was designated pOIL160. A 10.019 kb 'Monocot senescence part1' fragment containing the following expression cassettes was synthesized: *O. sativa* Actin1::*A. thaliana* DGAT1, codon optimized for *Z. mays* expression, *Z. mays* SEE1::*Z. mays* WRI1, *Z. mays* SEE1::*Z. mays* LEC1. This fragment was subcloned as a SpeI-EcoRV fragment into the SpeI-StuI sites of pOIL160, resulting in pOIL161. A second 7.967 kb 'Monocot senescence part2' fragment was synthesized and contains the following elements: MAR, *Z. mays* Ubiquitin::hpRNAi fragment targeted against *S. bicolor*/*T. aestivum* SDP1, empty cassette under the control of the *O. sativa* Actin1 promoter. The sequences of two *S. bicolor* SDP1 TAG lipases (Accession Nos. XM_002463620; SEQ ID NO:233 and XM_002458486; SEQ ID NO:169) and one *T. aestivum* SDP1 sequence (Accession No. AK334547) (SEQ ID NO: 234) were obtained by a BLAST search with the *A. thaliana* SDP1 sequence (Accession No. NM_120486). A synthetic hairpin construct (SEQ ID NO:235) was designed including four fragments (67 bp, 90 bp, 50 bp, 59 bp) of the *S. bicolor* XM_002458486 sequence that showed highest degree of identity with the *T. aestivum* SDP1 sequence. In addition, a 278 bp fragment originating from the *S. bicolor* XM_002463620 SDP1 lipase was included to increase silencing efficiency against both *S. bicolor* SDP1 sequences. The 'Monocot senescence part2' fragment is subcloned as a BsiWI-EcoRV fragment into the BsiWI-Fsp1 sites of pOIL161. The resulting vector is designated pOIL162.

The genetic constructs pOIL156 pOIL157, pOIL161 and pOIL162 are used to transform *S. bicolor* and *T. aestivum* using *Agrobacterium*-mediated transformation. Transgenic plants are selected for hygromycin resistance and contain elevated levels of TAG and TFA in vegetative tissues compared to untransformed control plants. Such plants are useful for providing feed for animals as hay or silage, as well as producing grain, or may be used to extract oil.

Further genetic constructs are made for expression of combinations of polypeptides in leaves and stems of monocotyledonous plants, including the C4-photosynthesis plants *S. bicolor* and *Z. mays*. Several constructs are made containing genes for expression of WRI1, DGAT and oleosin, with each gene under the control of a constitutive promoter such as a maize Ubiquitin gene promoter or a rice actin gene promoter, and containing an NPTII gene as selectable marker gene. In one particular construct, the WRI1 is *sorghum* WRI1. In another, the oleosin is SiOleosinL (see Example 17). In other particular constructs, the oleosin gene is replaced with a gene encoding either LDAP2 or LDAP3 from *S. sebiferum* (Example 11). These constructs are used as the "core constructs" for transformation of *S. bicolor* and *Z. mays* and are deployed on their own or in combination with genetic constructs for expression of a hairpin RNA targeting one or more SDP1 genes in *sorghum* or maize (see above), a construct encoding Lec2 under the control of a SEE1 promoter (senescence specific), or both. Another construct is made comprising three genes, namely for expression of a hairpin RNA targeting the endogenous TGD5 gene to reduce its expression, a FatA fatty acyl thioesterase and a PDAT, which is used to increase the level of TAG and/or the TTQ parameter for plants transformed with this construct.

Example 15. Extraction of Oil

Extraction of Lipid from Leaves

Transgenic tobacco leaves which had been transformed with the T-DNA from pJP3502 were harvested from plants grown in a glasshouse during the summer months. The leaves were dried and then ground to 1-3 mm sized pieces prior to extraction. The ground material was subject to soxhlet (refluxing) extraction over 24 hours with selected solvents, as described below. 5 g of dried tobacco leaf material and 250 ml of solvent was used in each extraction experiment.

Hexane Solvent Extraction

Hexane is commonly used as a solvent commercially for oil extraction from pressed oil seeds such as canola, extracting neutral (non-polar) lipids, and was therefore tried first. The extracted lipid mass was 1.47 g from 5 g of leaf material, a lipid recovery of 29% by weight. 1H NMR analysis of the hexane extracted lipid in DMSO was preformed. The analysis showed typical signals for long chain triglyceride fatty acids, with no aromatic products being present. The lipid was then subjected to GCMS for identification of major components. Direct GCMS analysis of the hexane extracted lipid proved to be difficult as the boiling point was too high and the material decomposed in the GCMS. In such situations, a common analysis technique is to first make methyl esters of the fatty acids, which was done as follows: 18 mg lipid extract was dissolved in 1 mL toluene, 3 mL of dry 3N methanolic HCL was added and stirred overnight at 60° C. 5 mL of 5% NaCl and 5 mL of hexane were added to the cooled vial and shaken. The organic layer was removed and the extraction was repeated with another 5 mL of hexane. The combined organic fractions were neutralized with 8 mL of 2% KHCO3, separated and dried with Na2SO4. The solvent was evaporated under a stream of N2 and then made up to a concentration of 1mg/mL in hexane for GCMS analysis. The main fatty acids present were 16:0 (palmitic, 38.9%) and 18:1 (oleic, 31.3%).

| | FA | | | | | | |
|---|---|---|---|---|---|---|---|
| | 16:0 | 16:1 | 18:0 | 18:1 | 18:2 | 20:0 | 22:0 |
| % wt | 38.9 | 4.6 | 6.4 | 31.3 | 2.5 | 1.5 | 0.6 |

Acetone Solvent Extraction

Acetone was used as an extraction solvent because its solvent properties should extract almost all lipid from the leaves, i.e. both non-polar and polar lipids. The acetone extracted oil looked similar to the hexane extracted lipid. The extracted lipid mass was 1.59 g from 5 g of tobacco leaf, i.e. 31.8% by weight. 1H NMR analysis of the lipid in DMSO was performed. Signals typical of long chain triglyceride fatty acids were observed, with no signal for aromatic products.

Hot Water Solvent Extraction

Hot water was attempted as an extraction solvent to see if it was suitable to obtain oil from the tobacco leaves. The water extracted material was gel like in appearance and gelled when cooled. The extracted mass was 1.9 g, or 38% by weight. This material was like a thick gel and was likely to have included polar compounds from the leaves such as sugars and other carbohydrates. The 1H NMR analysis of the material in DMSO was preformed. The analysis showed typical signals for long chain triglyceride fatty acids, with no aromatic products being extracted. The left over solid material was extracted with hexane, yielding 20% of lipid by weight, indicating that the water extraction had not efficiently extracted non-polar lipids.

Ethanol Solvent Extraction

Ethanol was used as an extraction solvent to see if it was suitable to obtain oil from the tobacco leaves. The ethanol extracted lipid was similar in appearance to both the water- and hexane-extracted lipid, being yellow-red in colour, had a gel-like appearance and gelled when cooled. The extracted lipid mass was 1.88 g from 5 g tobacco, or 37.6% by weight. The ethanol solvent would also have extracted some of the polar compounds in the tobacco leaves.

Ether Solvent Extraction

Diethyl ether was attempted as an extraction solvent since it was thought that it might extract less impurities than other solvents. The extraction yielded 1.4 g, or 28% by weight. The ether extracted lipid was similar to the hexane extracted material in appearance, was yellowish in colour, and it did appear a little cleaner than the hexane extract. While the diethyl ether extraction appeared to have given the cleanest oil, the NMR analysis showed a mixture of more organic compounds.

Example 16. Feed Rations for Dairy Cows

Leaves and stems from *sorghum* or corn plants comprising increased TAG and TFA contents are harvested and chopped into pieces 1-2 cm in size. The processed plant parts are ensiled for at least two weeks and then mixed with other components to produce a feedstuff for dairy cows. The feed mixture for dairy cows comprises: 7.5-10 kg of *sorghum* or corn silage comprising increase TAG and TFA, 4-5 kg of alfalfa hay, 1 kg brewers grain (about 67% digestible dry matter), 1-2 kg seed meal (canola or soy) or cottonseed, 0.5 kg molasses and mineral supplements such as calcium, phosphorus, magnesium and sulfur. Lipid is optimally present at 5-7% of the total dry matter. Additional amino acids such as lysine and methionine or non-protein nitrogen supplies such as urea may be added, depending on the total protein content. The feedstuff has increased energy density, increased feed value, increased nutritive value and increased digestibility relative to a corresponding feedstuff made with an equivalent amount of wild-type sorghum or corn silage. The increased lipid in the high-oil sorghum or corn silage results in an additional milk production of up to 3 litres per day and an increase of 0.33% in milk fat for each kilogram of lipid eaten.

A heifer will eat the equivalent of about 2.3% of her body weight daily and an adult dry cow will eat the equivalent of about 1.5% of her body weight daily. For example, a 300 kg heifer can eat up to 7 kg dry matter and an adult, dry cow weighing 470 kg will eat about the same amount. Lactating cows have greater feed intakes, up to about 4% of body weight per day. Indeed, feed intake on a weight basis tends to increase with feed quality and palatability.

Example 17. Expression of Oil Body Proteins in Plant Vegetative Tissues

A protein coding region encoding a *Rhodococcus opacus* TadA lipid droplet associated protein (MacEachran et al. 2010; Accession number HM625859), codon optimized for expression in dicotyledonous plants such as *Nicotiana benthamiana*, was synthesised as a NotI-SpeI DNA fragment. The fragment was inserted downstream of the 35S promoter in pJP3343 using the NotI-SpeI sites. The resultant plasmid was designated pOIL380. A protein coding region encoding a *Sesame indicum* OleosinL lipid droplet associated protein (Tai et al. 2002; Accession number AF091840; SEQ ID NO:305) was synthesised as a NotI-SacI DNA fragment and inserted downstream of the 35S promoter in pJP3343 using the same sites. The resultant plasmid was designated pOIL382. A protein coding region encoding a *Sesame indicum* OleosinH1 lipid droplet associated protein (Tai et al., 2002; Accession number AF302807) was synthesised as a NotI-SacI DNA fragment and cloned downstream of the 35S promoter in pJP3343 using the same sites. The resultant plasmid was designated pOIL383. A variant of the protein coding region encoding *S. indicum* OleosinH1 having three amino acid substitutions to remove ubiquitination sites (K130R, K143R, K145R) (Hsiao and Tzen, 2011) was generated by targeted mutagenesis. The coding region was inserted downstream of the 35S promoter in pJP3343 as a NotI-SacI fragment. The resultant plasmid was designated pOIL384. A protein coding region encoding a *Vanilla planifolia* leaf OleosinU1 lipid droplet associated protein (Huang and Huang, 2016; Accession number SRX648194) was codon optimized for expression in *N. benthamiana*, synthesised as a SpeI-EcoRI DNA fragment and inserted downstream of the 35S promoter in pJP3343 using the same sites. The resultant plasmid was designated pOIL386. A protein coding region encoding a *Persea americana* mesocarp OleosinM lipid droplet associated protein (Huang and Huang 2016; Accession number SRX627420) was codon optimized for expression in *N. benthamiana*, synthesised as a SpeI-EcoRI DNA fragment and inserted downstream of the 35S promoter in pJP3343 using the same restriction sites. The resultant plasmid was designated pOIL387. A protein coding region encoding an *Arachis hypogaea* Oleosin 3 lipid droplet associated protein (Parthibane et al., 2012a; Accession number AY722696) was codon optimized for expression in *N. benthamiana*, flanked by NotI sites and inserted into the binary expression vector pJP3502. The resulting plasmid, pOIL041, was digested with NotI and the resultant 520 bp DNA fragment was inserted downstream of the 35S promoter of pJP3343. The resultant plasmid was designated pOIL190. Similarly, the protein coding region for the *A. thaliana* Caleosin3 lipid droplet associated protein (Shen et al., 2014; Laibach et al., 2015; Accession number AK317039) was codon optimized for expression in *N. benthamiana*, flanked by NotI sites and inserted into pJP3502. The resulting plasmid, pOIL042, was digested with NotI and the resulting 604 bp DNA fragment was inserted downstream of the 35S promoter of pJP3343. The resultant plasmid was designated pOIL191. A protein coding region encoding an *A. thaliana* steroleosin lipid droplet associated protein (Accession number AT081653) was codon optimized for expression in *N. benthamiana*, flanked by NotI sites and inserted into pJP3502. The resultant plasmid, pOIL043, was digested with NotI and the resultant 1069 bp DNA fragment was inserted downstream of the 35S promoter of pJP3343. The resultant plasmid was designated pOIL192. A protein coding region encoding a *Nannochloropsis oceanica* LSDP oil body protein (Vieler et al., 2012; Accession number JQ268559) was codon optimized for expression in *N. benthamiana*, flanked by NotI sites and inserted into the pJP3502 binary expression vector. The resultant plasmid, pOIL044, was digested with NotI and the 496 bp DNA fragment was inserted downstream of the 35S promoter of pJP3343. The resultant plasmid was designated pOIL193. A protein coding region encoding a *Trichoderma reesei* HFBI hydrophobin (Linder et al., 2005; Accession number Z68124) was codon optimized for expression in *N. benthamiana*, flanked by NotI sites and inserted into pJP3502. The resultant plasmid, pOIL045, was digested with NotI and the 313 bp DNA fragment was inserted downstream of the 35S promoter of pJP3343. The resultant plasmid was designated pOIL194. An ER-targeted variant of the *Trichoderma reesei* HFBI hydrophobin was created by amending the KDEL ER retention peptide to the C-terminus (Gutierrew et al., 2013). This variant was codon optimized for expression in *N. benthamiana* and cloned as a NotI fragment into pJP3502, resulting in pOIL046. Subsequently, pOIL046 was digested with NotI and the 325 bp fragment was inserted into pJP3343. The resulting vector was designated pOIL195.

Each of the genetic constructs encoding the lipid droplet associated polypeptides were introduced into *N. benthamiana* leaves in combination with genetic constructs encoding WRI1, DGAT1 and p19 as described in Example 1 with some minor modifications. *Agrobacterium tumefaciens* cultures containing the gene coding for the p19 silencing suppressor protein and the chimeric genes of interest were mixed such that the final OD600 of each culture was equal to 0.125 prior to infiltration. Samples being compared were located on the same leaf. After infiltration, *N. benthamiana* plants were grown for a further five days before leaf discs were harvested, pooled across three leaves from the same plant, freeze-dried, weighed and stored at −80° C. Total lipids were extracted from freeze-dried tissues using chloroform:methanol:0.1 M KCl (2:1:1 v/v/v) and aliquots loaded on a thin layer chromatography (TLC) plate and developed in hexane:diethyl ether:acetic acid (70:30:1, v/v/v). TAG was recovered, converted to FAME in the presence of a known amount of triheptadecanoin (Nu-Chek PREP, Inc. USA) as internal standard for lipid quantitation, and analysed by GC-FID.

The assays showed a range of TAG levels compared to the WRI1+DGAT1 control. Some constructs encoding lipid droplet associated polypeptides increased the TAG level relative to the control in some assays whereas others did not. A consistent and statistically significant increase in TAG content was observed when the construct expressing SiOleosinL (pOIL382) was introduced (FIG. 20); this construct was superior to all the others tested in these assays. An increase in the levels of C18:2 and C18:1 and a decrease in C16:0 was also observed in the TAG for this construct, relative to the p19+WRI1+DGAT1 control (FIG. 20). Microscopic analyses to visualise lipid droplets in the leaf cells expressing SiOleosinL showed a decrease in lipid droplet size and an increase in abundance compared to the control.

Further assays were carried out using radiolabelled [14C]-acetate to measure the rate of TAG synthesis for the different gene combinations including each of the lipid droplet associated polypeptides. The [14C]-acetate was infiltrated into the same leaf tissues at 3 days post-infiltration of the genetic constructs i.e. after the genes had been expressed for three days. Three hours later, leaf discs were harvested and total lipids in the tissues were extracted and fractionated by TLC. The amount of radioactivity in different lipid types was quantitated using a Fujifilm FLA-5000 phosphorimager. These assays demonstrated an increase in TAG synthesis rates in the leaves expressing SiOleosinL (pOIL382) as well as an increase in PC and PA synthesis rates over the three hours in leaves expressing SiOleosinL. In contrast, the genetic constructs encoding SiOleosinH, vanilla leaf and avocado mesocarp oleosins did not show a significant effect on TAG synthesis rate or content.

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

All publications discussed and/or referenced herein are incorporated herein in their entirety.

Any discussion of documents, acts, materials, devices, articles or the like which has been included in the present specification is solely for the purpose of providing a context for the present invention. It is not to be taken as an admission that any or all of these matters form part of the prior art base or were common general knowledge in the field relevant to the present invention as it existed before the priority date of each claim of this application.

REFERENCES

Alemanno et al. (2008) Planta 227:853-866.
Almeida and Allshire (2005) TRENDS Cell Biol. 15:251-258.
Alonso et al. (2009) Plant Cell 21: 1747-1761.
Alonso et al. (2010) Green Chem. 12:1493-1513.
Alvarez et al. (2000) Theor. Appl. Genet. 100:319-327.
Andre et al (2012) Proc. Natl. Acad. Sci. U.S.A. 109:10107-10112.
Andrianov et al. (2010) Plant Biotech. J. 8:277-287.
Awai et al (2006) Biochem. Soc. Trans. 34:395-398.
Bartlett et al. (2008) Plant Methods 4:22.
Bates (2016). Biochim et Biophys Acta 1961:1214-1225.
Bates and Browse (2011). Plant J. 68:387-399.
Baud et al. (2007) Plant J. 50:825-838.
Baud and Lepiniec (2010) Progr. Lipid Res. 49: 235-249.
Baumlein et al. (1991) Mol. Gen. Genet. 225:459-467.
Baumlein et al. (1992) Plant J. 2:233-239.
Belide et al. (2013) Plant Cell Tiss. Org. Cult. DOI 10.1007/s11240-013-0295-1.
Ben Saad et al. (2011) Transgenic Res 20: 1003-1018.
Benning et al (2008) Prog. Lipid Res. 47:381-389.
Benning et al (2009) J. Biol. Chem 284:17420-17427.
Bibikova et al. (2002) Genetics 161:1169-1175.
Bihmidine et al. (2015) BMC Plant Biology 15:186.
Bihmidine et al. (2016) Plant Signaling & Behaviour 11: e1117721.
Bligh and Dyer (1959) Canadian Journal of Biochemistry and Physiology 37:911-917.
Bourque (1995) Plant Sci. 105:125-149.
Boutilier et al. (2002) Plant Cell 14:1737-1749.
Bouvier-Nave et al. (2000) European Journal of Biochemistry/FEBS 267:85-96.
Bradford (1976) Anal. Biochem. 72:248-254.
Braun & Slewinski (2010), Plant Physiol 153: 1940.
Broothaerts et al. (2005) Nature 433:629-633.
Broun et al. (1998) Plant J. 13:201-210.
Browse et al. (1986) Biochem J 235: 25-31.
Buchanan-Wollaston (1994) Plant Physiol. 105:839-846.
Busk et al. (1997) Plant J. 11:1285-1295.
Cao et al. (2007) J. Lipid Res. 48:583-591.
Capuano et al. (2007) Biotechnol. Adv. 25:203-206.
Chen et al (2011) Plant Physiol. 155:851-865.
Chikwamba et al. (2003) Proc. Natl. Acad. Sci. U.S.A. 100:11127-11132.
Christie (1993) Advances in Lipid Methodology-Two, Oily Press, Dundee, pp 195-213.
Chung et al. (2006) BMC Genomics 7:120.
Comai et al. (2004) Plant J 37: 778-786.
Cong et al. (2013) Science 339:819-823.
Corrado and Karali (2009) Biotechnol. Adv. 27:733-743.
Coutu et al. (2007) Transgenic Res. 16:771-781.
Dahlqvist et al. (2000), Proc. Natl. Acad. Sci. U.S.A. 97: 6487-6492.
Damaj et al., (2010) Planta 231:1439-1458.
Dandik and Aksoy (1998) Fuel Process Technol. 57: 81-92.
Dauk et al (2007) Plant Sci. 173:43-49.
Dulermo and Nicaud (2011) Metab. Eng. 13:482-491.
Durrett et al. (2008) Plant J. 54:593-607.
Dyer et al. (2002) Plant Physiol. 130:2027-2038.
Eastmond et al. (2006) Plant Cell 18: 665-675.
Ellerstrom et al. (1996) Plant Mol. Biol. 32:1019-1027.
Endalew et al. (2011) Biomass and Bioenergy 35:3787-3809.
Fan et al. (2013) Plant Cell 25: 3506-3518.
Fan et al. (2013) Plant Journal 76: 930-942.
Fan et al. (2014) Plant Cell 26: 4119-4134.
Fan et al. (2015) Plant Cell 27: 2941-2955.
FAO Animal Production and Health Proceedings (2002) Protein sources for the animal feed industry, Expert Consultation and Workshop, Bangkok.
Feeney et al. (2012) Plant Physiol 162: 1881-1896.
Finkelstein et al. (1998) Plant Cell 10:1043-1054.
Froissard et al. (2009) FEMS Yeast Res 9:428-438.
Gan (1995) Molecular characterization and genetic manipulation of plant senescence. PhD thesis. University of Wisconsin, Madison.
Gan and Amasino (1995) Science 270:1986-1988.
Gazzarrini et al. (2004) Dev. Cell 7:373-385.
Ghosal et al. (2007) Biochimica et Biophysica Acta 1771: 1457-1463.
Ghosh et al. (2009) Plant Physiol. 151:869-881.
Gidda et al (2013) Plant Signaling Behay. 8:e27141.
Girijashankar and Swathisree, (2009) Physiol. Mol. Biol. Plants 15: 287-302.
Gong and Jiang (2011) Biotechnol. Lett. 33:1269-1284.
Gould et al. (1991) Plant Physiol. 95:426-434.
Greenwell et al. (2010) J. R. Soc. Interface 7:703-726.
Guan et al. (2015) Lipids 50:407-416.
Gurel et al. (2009) Plant Cell Rep. 28:429-444.
Gutierrez et al. (2013) BMC Biotechnol. 13: 40.

Hedrich et al. (2015) Curr Opin Plant Biol 25: 63-70.
Hershey and Stoner (1991) Plant Mol. Biol. 17:679-690.
Hinchee et al. (1988) Biotechnology 6:915-922.
Horn et al. (2007) Euphytica 153:27-34.
Hong et al. (2016). Progr Lipid Res 62:55-74.
Horn et al. (2013). Plant Physiol 162:1926-1936.
Horvath et al. (2000) Proc. Natl. Acad. Sci. U.S.A. 97:1914-1919.
Hsiao and Tzen (2011) Plant Physiol. Biochem. 49: 77-81.
Hu et al. (2012) Plant Physiol. 158:1944-1954.
Huang (1996) Plant Physiol. 110:1055-1061.
Huang et al. (2010). In Vitro Biology Meeting and IAPB 12th World Congress 2010, S93-S211
Huang and Huang (2016) Plant Physiol. 171: 1867-1878.
Ichihara et al (1988) Biochim. Biophys. Acta 958:125-129.
Ikeda et al. (2006) Pl Biotech J. 23: 153-161.
Iwabuchi et al. (2003) J. Biol. Chem. 278:4603-4610.
James et al. (2010) Proc. Natl. Acad. Sci. USA 107:17833-17838.
Jepson et al. (1994) Plant Mol. Biol. 26:1855-1866.
Jiang, et al. (2013) Nucleic Acids Research 41(20) e188.
Jolivet et al. (2014) Plant Physiol. Biochem. 42:501-509.
Jones et al. (1995) Plant Cell 7: 359-371.
Karmakar et al. (2010) Bioresource Technology 101:7201-7210.
Kelly et al. (2011) Plant Physiol. 157: 866-875.
Kelly et al (2013a) Plant Biotech. J. 11:355-361.
Kelly et al. (2013b) Plant Physiol. 162:1282-1289.
Kereszt et al. (2007) Nature Protocols 2:948-952.
Kim et al. (1996) Proc. Natl. Acad. Sci. USA 93:1156-1160.
Kim et al. (2016), Plant Physiol 171: 1951-1964.
Klemens et al. (2013) Plant Physiol 163: 1338-1352.
Koziel et al. (1996) Plant Mol. Biol. 32:393-405.
Kuhn et al. (2009) J. Biol. Chem. 284:34092-102.
Kunst et al. (1988) Proc. Natl. Acad. Sci. U.S.A. 85:4143-4147.
Kwong et al. (2003) Plant Cell 15:5-18.
Lacroix et al. (2008) Proc. Natl. Acad. Sci. U.S.A. 105: 15429-15434.
Laemmli (1970) Nature 227: 680-685.
Laibach et al. (2015). J. Biotechnol. 201: 15-27.
Lardizabal et al. (2008) Plant Physiol. 148: 89-96.
Larkin et al. (1996) Transgenic Res. 5:325-335.
Lebrun et al. (1987) Nucl. Acids Res. 15:4360.
Laux et al. (1996) Development 122: 87-96.
Lazo et al. (1991) Bio/Technology 9:963-967.
Lee et al. (1998) Science 280:915-918.
Lee et al., (2003) Proc. Natl. Acad. Sci. U.S.A. 100:2152-2158.
Li-Beisson et al (2013) The *Arabidopsis* Book, 2013.
Li et al. (1996) FEBS Lett. 379:117-121.
Li et al. (2006) Phytochemistry 67: 904-915.
Li et al. (2016). *Inter. J. Agric. Biol.* doi: 10.17957/IJAB/15.0075.
Lin et al. (2005) Plant Physiol. Biochem. 43:770-776.
Linder et al. (2005). FEMS Microbiol. Rev. 29: 877-896.
Liu and Godwin (2012). *Plant Cell Reports* 31, 999-1007.
Liu et al. (2010) Plant Physiol. Biochem. 48: 9-15.
Liu et al. (2012) J Exp Bot 63: 3727-3740.
Liu et al. (2014) BMC Plant Biol. 14: 73.
Liu et al. (2015). *South African Journal of Botany* 98, 157-160.
Liu et al. (2015b). Plant Cell 27:1512-1528.
Lotan et al. (1998) Cell 93: 1195-1205.
Lu et al (2007) J. Biol. Chem. 282: 35945-35953.
Lu et al. (2009) Proc Natl Acad of Sci USA 106:18837-18842.
Luerssen et al. (1998) Plant J. 15: 755-764.
Lui et al. (2009) J. Agric. Food Chem. 57: 2308-2313.
Ma et al. (2016) Plant Journal doi: 10.1111/tpj.13244.
MacEachran et al. (2010). Appl. Environ. Microbiol. 76: 7217-7225.
Maher and Bressler (2007) Bioresource Technology 98:2351-2368.
Matsuoka et al. (1994) Plant J. 6:311-319.
Matsuoka and Minami (1989) Eur. J. Biochem. 181: 593-598.
McCleary et al. (2013) J AOAC Int 93:221-233.
McCleary et al. (2015) Starch 67:860-883.
McElroy et al. (1990) Plant Cell 2: 163-171.
McKinley et al. (2016) Plant Journal: doi:10.1111/tpj.13269.
Meier et al. (1997) FEBS Lett. 415:91-95.
Millar and Waterhouse (2005). Funct Integr Genomics 5:129-135.
Miller (1984). *Crop Sci* 24:1224-1224.
Mizuno et al., (2016) Biotechnol Biofuels 9: 127.
Mojica et al. (2000) Mol Microbiol 36:244-246.
Mongrand et al. (1998) Phytochemistry 49:1049-1064.
Morelle et al., (2005). Eukaryot Cell 4:1308-1316.
Moreno-Perez (2012) PNAS 109: 10107-10112.
Moyle and Birch (2013) Theor. Appl. Genet. 126:1775-1782.
Mu et al. (2008) Plant Physiol. 148:1042-1054.
Mudge et al., (2013) Plant Biotechnol. J. 11:502-509.
Murashige and Skoog (1962). *Physiol Plant* 15:473-497.
Murphy et al. (2012). Protoplasma 249:541-585.
Naim et al. (2012) PLoS One 7: e52717.
Nakamura et al., (2005). J Biol Chem 280:7469-7476.
Needleman and Wunsch (1970) J. Mol Biol. 45: 443-453.
Nilsson et al. (2012) Physiol. Plantarum 144: 35-47.
Nishida et al (1993) Plant Mol. Biol. 21:267-277.
Nomura et al. (2000) Plant Mol. Biol. 44: 99-106.
Ohlrogge and Browse (1995) Plant Cell 7: 957-970.
Padidam (2003) Curr. Opin. Plant Biol. 6:169-77.
Padidam et al. (2003) Transgenic Res. 12:101-9.
Parthibane et al. (2012a) J. Biol. Chem. 287:1946-1965.
Parthibane et al. (2012b) Plant Physiol. 159:95-104.
Pasquinelli et al. (2005). Curr. Opin. Genet. Develop. 15:200-205.
Pearson and Lipman (1988) Proc. Natl. Acad. Sci. USA 85:2444-2448.
Perez-Vich et al. (1998) J.A.O.C.S. 75:547-555.
Perrin et al. (2000) Mol. Breed. 6:345-352.
Petrie et al. (2012) PLOS One 7: e35214.
Phillips et al. (2002) Journal of Food Composition and Analysis 12:123-142.
Pokotylo et al., 2013. Progr Lipid Res. 52:62-79.
Potenza et al. (2004) In Vitro Cell Dev. Biol. Plant 40:1-22.
Prosky et al. (1985) J AOAC Chem 68:677-679.
Qazi et al. (2012) Journal of Plant Physiology 169: 605-613.
Qiu et al. (2001) J. Biol. Chem. 276:31561-3156.
Robson et al. (2004) Plant Biotechnol J 2:101-112.
Rossell and Pritchard (1991) *Analysis of Oilseeds, Fats and Fatty Foods.* Elsevier
Roston et al (2012) J. Biol. Chem. 287:21406-21415.
Ruuska et al. (2002) Plant Cell 14:1191-1206.
Saha et al. (2006) Plant Physiol. 141:1533-1543.
Sanjaya et al. (2011) Plant Biotechnol J 9:874-883.
Santos-Mendoza et al. (2005) FEBS Lett. 579:4666-4670.
Santos-Mendoza et al. (2008) Plant J. 54:608-620.
Schneider et al. (2012) Plant Biol 14: 325-336.
Schnurr et al. (2002) Plant Physiol 129:1700-1709.
Scott et al. (2010) Plant Biotechnol. J. 8:912-27.
Shaw et al. (1959) J Soil Sci 10:316-326.

Shen et al. (2010) Plant Phys. 153: 980-987.
Shen et al. (2014). Biochem. Biophys. Res. Comm. 448: 365-371.
Semwal et al. (2011) Bioresource Technology 102:2151-2161.
Senior (1998) Biotech. Genet. Engin. Revs. 15:79-119.
Shen et al. (2010) Plant Physiol. 153:980-987.
Shiina et al. (1997) Plant Physiol. 115:477-483.
Shimada and Hara-Nishimura (2010) Biol. Pharm. Bull. 33:360-363.
Shimada et al. (2014) Plant Physiol. 164:105-118.
Shockey et al. (2002) Plant Physiol 129:1710-1722.
Singh et al., (2013). PLoS One 8, e62494.
Slade and Knauf (2005) Transgenic Res. 14: 109-115.
Slocombe et al. (2009) Plant Biotechnol. J. 7: 694-703.
Smith et al. (2000) Nature 407:319-320.
Somerville et al. (2000) Lipids. In B B Buchanan, W Gruissem, R L Jones, eds, Biochemisty and Molecular Biology of Plants. American Society of Plant Physiologists, Rockville, Md., pp 456-527.
Srinivasan et al. (2007) Planta 225:341-51.
Stalker et al. 1988 Science 242: 419-423.
Stone et al. (2001) Proc. Natl. Acad. Sci. U.S.A. 98: 11806-11811.
Stone et al. (2008) Proc. Natl. Acad. Sci. U.S.A. 105: 3151-3156.
Tai et al. (2002). Biosci. Biotechnol. Biochem. 66: 2146-2153.
Tan et al. (2011) Plant Physiol. 156:1577-1588.
Taylor (1997) The Plant Cell 9:1245-1249.
Thillet et al. (1988) J. Biol. Chem 263:12500-12508.
Tingay et al. (1997) Plant J. 11:1369-1376.
Titball 1993. Microbiol Rev 57:347-366.
To et al. (2012) Plant Cell 24:5007-5023.
Ulmasov et al. (1995) Plant Physiol. 108:919-927.
van de Loo et al. (1995) Proc Natl Acad Sci USA. 92:6743-6747.
Vanhercke et al. (2013) FEBS Letters 587:364-369.
Vanhercke et al. (2014). Plant Biotech. J. 12:231-239.
Vieler et al. (2012) Plant Physiol. 158:1562-1569.
Voinnet et al. (2003) Plant J. 33:949-956.
Wang and Benning (2012) Plant J 70:614-623.
Wang et al., (2001). Annu Rev Plant Physiol Plant Mol Biol 52:211-231.
Wang et al. (2002) Plant J 32:831-843.
Wang (2005). Plant Physiol 139:566-573.
Waterhouse et al. (1998). Proc. Natl. Acad. Sci. U.S.A. 95:13959-13964.
Weissbach and Weissbach, (1989) Methods for Plant Mol Biol, Academic Press.
Weissbach et al., In: Methods for Plant Molecular Biology, Academic Press, San Diego, Calif., (1988).
Winichayakul et al. (2013) Plant Physiol. 162:626-639.
Wood et al. (2009) Plant Biotech. J. 7: 914-924.
Wormit et al. (2006) Plant Cell 18: 3476-3490.
Wright et al. (2006) Methods Mol Biol. 343:120-135.
Wu et al. (2014) In Vitro Cellular and Dev. Biol.-Plant 50:9-18.
Xie et al. (2014) Mol. Plant 7:923-926.
Xu et al (2010) Plant and Cell Physiol. 51:1019-1028.
Xu et al (2005) Plant Cell 17:3094-3110.
Xu et al (2008) Plant Cell 20:2190-2204.
Yamagishi et al. (2005) Pl Physiol 139: 163-173.
Yamasaki et al. (2004) Plant Cell 16:3448-3459.
Yang et al. (2003) Planta 216:597-603.
Yang et al. (2010) Proc. Natl. Acad. Sci. U.S.A. 107:12040-12045.
Yen et al. (2002) Proc. Natl. Acad. Sci. U.S.A. 99:8512-8517.
Yen et al. (2005) J. Lipid Res. 46: 1502-1511.
Yokoyama et al. (1994) Mol Gen Genet 244: 15-22.
Zale et al. (2016), Plant Biotech J. 14: 661-669.
Zheng et al. (2009) Pl Physiol 21: 2563-2577.
Zienkiewicz et al. (2017) Biotechnology for Biofuels 10 doi:http://dx.doi.org/10.1186/s13068-016-0686-8
Zolman et al (2001) Plant Physiol. 127:1266-1274.
Zulu et al. (2017) Biotechnology for Biofuels, 10 doi:https://doi.org/10.1186/s13068-017-0874-1.

---

SEQUENCE LISTING (323 sequences)

SEQ ID NO: 1 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 2 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 3 - protein, 340 aa, Ricinus communis
MGEEANHNNNNNNINSNDEKNEEKSNYTVVNSRELYPTNIFHALLALSIWIGSIHFNLFLLFISYLFLSFPTFLLIVGFFVVLMFIPIDEHSKLGRRLCRYVCRHACSHFPVTLHVEDMNAFHSDRAYVFGYEPHSVFPLGVSVLSDHFAVLPLPKMKVLASNAVFRTPVLRHIWTWCGLTSATKKNFTALLASGYSCIVIPGGVQETFYMKHGSEIAFLKARRGFVRVAMEMGKPLVPVFCFGQSNVYKWWKPDGELFMKIARAIKFSPIVFWGVLGSHLPLQRPMHVVVGKPIEVKQNPQPTVEEVSEVQGQFVAALKDLFERHKARVGYADLTLEIL

SEQ ID NO: 4 - protein, 322 aa, Vernicia fordii
MGMVEVKNEEEVTIFKSGEIYPTNIFQSVLALAIWLGSFHFILFLVSSSIFLPFSKFLLVIGLLLFFMVIPINDRSKLGQCLFSYISRHVCSYFPITLHVEDINAFRSDRAYVFGYEPHSVFPIGVMILSLGLIPLPNIKFLASSAVFYTPFLRHIWSWCGLTPATRKNFVSLLSSGYSCILVPGGVQETFYMKQDSEIAFLKARRGFIRIAMQTGTPLVPVFCFGQMHTFKWWKPDGELFMKIARAIKFTPTIFWGVLGTPLPFKNPMHVVVGRPIEVKQNPQPTAEEVAEVQREFIASLKNLFERHKARVGYSDLKLEIF

SEQ ID NO: 5 - protein, 355 aa, Mortierella ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 6 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 7 - protein, 328 aa, Homo sapiens
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 8 - protein, 361 aa, Bos taurus
MKTLIAAYSGVLRGTGSSILSALQDLFSVTWLNRAKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 9 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 10 - protein, 3 aa, Artificial Sequence
  conserved sequence
YFP

SEQ ID NO: 11 - protein, 4 aa, Artificial Sequence
  conserved sequence
HPHG

SEQ ID NO: 12 - protein, 4 aa, Artificial Sequence
  conserved sequence
EPHS

SEQ ID NO: 13 - protein, 24 aa, Artificial Sequence
  conserved sequence
  X (2)..(2): any amino acid
  X (5)..(5): any amino acid
  X (6)..(6): Lysine (K) or Arginine (R)
  X (7)..(7): any amino acid
  X (9)..(11): any amino acid
  X (13)..(15): any amino acid
  X (16)..(16): Leucine (L) or Valine (V)
  X (19)..(21): any amino acid
  X (24)..(24): Glutamic Acid (E) or Glutamine (Q)
RXGFXXXAXXXGXXXXVPXXXFGX

SEQ ID NO: 14 - protein, 8 aa, Artificial Sequence
  conserved sequence
  X (3)..(3): any amino acid
  X (5)..(7): any amino acid
FLXLXXXN

SEQ ID NO: 15 - protein, 118 aa, Artificial Sequence
  conserved sequence
ALVVANHQSFLDPLVLSALLPRKGGRVRFVAKKELFYVPLLGWLLRLLGAIFIDRENGRLARAALREAVRLLRDGGWLLIFPEGTRSRPGKLLPFKKGAARLALEAGVPIVPVAIRGT

SEQ ID NO: 16 - protein, 187 aa, Artificial Sequence
  conserved sequence
  X (15)..(15): any amino acid
  X (18)..(18): any amino acid
  X (23)..(23): any amino acid
  X (25)..(26): any amino acid
  X (28)..(30): any amino acid
  X (32)..(33): any amino acid
  X (35)..(38): any amino acid
  X (41)..(41): any amino acid
  X (46)..(48): any amino acid
  X (53)..(53): any amino acid
  X (55)..(57): any amino acid
  X (61)..(61): any amino acid
  X (67)..(67): any amino acid
  X (72)..(72): any amino acid
  X (74)..(77): any amino acid
  X (79)..(79): any amino acid
  X (114)..(114): any amino acid
  X (127)..(128): any amino acid
  X (136)..(136): any amino acid
  X (139)..(142): any amino acid
  X (144)..(144): any amino acid
  X (150)..(150): any amino acid
  X (164)..(165): any amino acid
  X (167)..(172): any amino acid
AVFDKDGTLTEDDTXFLXYLLKXLXXLXXXLXXDXXXXGSXLTLSXXXDLLEXLXXXGGIXVIGLAXRYLEXLXXXXEXAKLFEGFIKPDAAELLKELHEAGLRVVVLTGDPRXIAKPVAKELGIDXXNVLATELXDEXXXXVXGRITGXLDKARAVERLVVLXXKXXXXXXVVAIGDSANDLPALK

SEQ ID NO: 17 - protein, 190 aa, Artificial Sequence
  conserved sequence
IKAVVFDKDGTLTDGEPPIAEAIVEAAAELGLPLLLPLEEVEKLLGRGVEGIERILLEGGLTAELLLELEGELAAGKTAVLVALDGEVLGLIALADKLYPGAREALKALKERGIKVAILTNGDRANAEAVLEALGLADLFDVIVDSDDVGPVKPKPEIFLKALERLGVKPEEVLMVGDGVNDAPALAAAG

SEQ ID NO: 18 - protein, 15 aa, Artificial Sequence
  conserved sequence
GDLVICPEGTTCREP

SEQ ID NO: 19 - protein, 6 aa, Artificial Sequence
  conserved sequence
  X (2)..(2): any amino acid
  X (4)..(4): any amino acid
  X (5)..(5): Threonine (T) or Valine (V)
  X (6)..(6): Leucine (L) or Valine (V)
DXDXXX

SEQ ID NO: 20 - protein, 8 aa, Artificial Sequence
  conserved sequence
  X (2)..(2): 17 to 20 amino acids; where the amino acids can be any amino acids
  X (3)..(3): Glycine (G) or Serine (S)
  X (4)..(4): Aspartic Acid (D) or Serine (S)
  X (5)..(7): any amino acid
  X (8)..(8): Aspartic Acid (D) or Asparagine (N)
KXXXXXXX

SEQ ID NO: 21 - protein, 356 aa, Arabidopsis thaliana
MDWEIRGSSLGQKLLEFDSEQERQTRFRAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 22 - protein, 430 aa, Arabidopsis thaliana
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 23 - protein, 430 aa, Arabidopsis lyrata
MKRRLTTSTSSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQPNHQEAILVEAKQEIETREAKEEPREEVKQQYVEEPPQEEKEEEKAEQQEAEFVGYKDEGAVVNCCIDSSAIMEMNRCGDNNELAWNFCMMDSGFAPFLTDQNLSNENPIEYPELFNELAFEDNIDFMFDEAKNDCLSLENLDCCVVGRESPTSSSSPLSCFSTDSASSTTTTTSVSCNYLGLFVGSE

SEQ ID NO: 24 - protein, 413 aa, Brassica napus
MKRPLTTSPSSSSSTSSSACILPTQSETPRPKRAKRAKKSSLRSDVKPQNPTSPASTRRSSIYRGVTRHRWTGRYEAHLWDKSSWNSIQNKKGKQVYLGAYDSEEAAAHTYDLAALKYWGPNTILNFPVETYTKELEEMQRCTKEEYLASLRRQSSGFSRGVSKYRGVARHHHNGRWEARIGRVFGNKYLYLGTYNTQEEAAAAYDMAAIEYRGANAVTNFDIGNYIDRLKKKGVFPFPVSQANHQEAVLAETKQEVEAKEEPTEEVKQCVEKEEAKEEKTEKKQQQEVEEAVITCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTATTVTSVSWNYSV

SEQ ID NO: 25 - protein, 415 aa, Brassica napus
MKRPLTTSPSTSSSTSSSACILPTQPETPRPKRAKRAKKSSIPTDVKPQNPTSPASTRRSSIYRGVTRHRWTGRYEAHLWDKSSWNSIQNKKGKQVYLGAYDSEEAAAHTYDLAALKYWGPDTILNFPAETYTKELEEMQRCTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVSQANHQEAVLAEAKQEVEAKEEPTEEVKQCVEKEEPQEAKEEKTEKKQQQQEVEEAVVTCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTTITSVSCNYSV

SEQ ID NO: 26 - protein, 285 aa, Glycine max
MKRSPASSCSSSTSSVGFEVHHPIEKRRPKHPRRNNLKSQKCKQNQTTTGGRRSSIYRGVTRHRWTGRFEAHLWDKSSWNNIQSKKGKQVYLGAYDTEESAARTYDLAALKYWGKDATLNFPIETYTKDLEEMDKVSREEYLASLRRQSSGFSRGISKYRGVARHHHNGRWEARIGRVCGNKYLYLGTYKTQEEAAVAYDMAAIEYRGVNAVTNFDISNYMDKIKKKNDQTLQQQQTEVQTETVPNSSDSEEAEVEQQHTTTITTPPPSENLHMLPQEHQVGGWV

SEQ ID NO: 27 - protein, 417 aa, Jatropha curcas
MKRSSASSCSSSSSSSSSPSSSSSSACSASSSCLDSVSPPNHHQLRSEKSKSKRIRKIQTKQDKCQTTATTTSPSGGGRRSSIYRGVTRHRWTGRFEAHLWDKSSWNNIQNKKGRQVYLGAYDNEEAAAHTYDLAALKYWGQDTTLNFPIETYSKELEEMQKMSKEEYLASLRRRSSGFSRGVSKYRGVARHHHNGRWEARIGRVFGNKYLYLGTYNTQEEAAAAYDMAAIEYRGANAVTNFDVSHYIDRLKKKGIPLDKILPETLSKGSKESEEIERTSPLPLPSPPSPSITPLHEEIVSPQLLETECPQHPPCMDTCTMIVMDPIEEHELTWSFCLDSGLVPLPVPDLPLANGCELPDLLDDTGFEDNIDLIFDACCFGNDANPADENGKERLSSASTSPSCSTTLTSVSCNYSV

SEQ ID NO: 28 - protein, 443 aa, Ricinus communis
MKRSPTSPCSSSSSSSYSSSSASSSCVGPDDTPVAPGSHHHHDHHQLRSQKSSKRIRKVKKKQQNHNIDQNNTNTTITAPTSARRSSIYRGVTRHRWTGRFEAHLWDKSSWNNIQNKKGRQGAYDNEEAAAHTYDLAALKYWGPETTLNFPIETYPKELEEMQKMSKEEYLASLRRQSSGFSRGVSKYRGVARHHHNGRWEARIGRVFGNKYLYLGTYNTQEEAAAAYDMAAIEYRGANAVTNFDISNYIDRLKKKGILLDQILPDQPLRKCSSESEEAEAEAEVERLPSLPSSILPQEQDTISPQLQCTQLLPSMDSCTMINMDPIEDNELTWSFCLDSGLTLFSVPELPLENACELPDLFDDTGFEDNIDLIFDGCCFGNDDDGGGGANHQEFMVESRGCRVGEVGISGSMEEENGKEMCCSSSSPSCSTTTSVSCCNYSV

SEQ ID NO: 29 - protein, 402 aa, Populus trichocarpa
MKRSSSCSSSSSSSSSSCVASESIHKPKAKRIRKNQKSNQGKSQNAAAAAANNSHNSGKRSSIYRGVTRHRWTGRFEAHLWDKSSWNSIQNKKGKQGAYDNEEAAAHTYDLAALKYWGSETTLNFPIETYTKEIEEMQKVTKEEYLASLRRQSSGFSRGVSKYRGVARHHHNGRWEARIGRVYGNKYLYLGTYNTQEEAAAAYDMAAIQYRGANAVTNFDVSNYIERLRKKGIPIDRILQEQQLLNNSVDSSVEVEVEQPTPPPQQQQEEQEQKIVSSSSQLQCSQLNSSLDGTPPMVIMDTIEEHELAWSFCMDSGLSLTMPDLPLENSCELPDLFDHTGFEDNIDLIFDACCYGKEANPAGYTLEDNSTGGVEEDRLSSDSVSNSPTSSTTTSVSCNYSV

SEQ ID NO: 30 - protein, 409 aa, Vitis vinifera
MVKRSSPGSSSSPSSSSTSSDAASRPAPPSGGKPKSRKKEAKKNSNGNGSNSKNKRTSIYRGVTKHRWTGRFEAHLWDKSSWNDISNKRGRQGAYYNEEAAARTYDLAALKYWGPTTPLNFPLETYQKDAEEMEKMSKEEYLALLRRQSNGFSRGVSKHHHNGRWEARIGRVLGNKYLYLGTYSTQEEAAAAYDMAAIEYRGLNAVTNFDISNYVKLGRVEAQVQELAQQLQPNTPIGPQNELQKEEEEQLQEPVLSSSQHLPSMDSSAMEIMDPADDPDLPWNFCAYSTLLVPDVPLGKGGELSDLFYEKGFEDNIDYMFEGAAGNEEESNSAENGVKENGFMHELEVDGKLQNVVGFFFLSFFFLPKRAGIRKRGVDSCMQLFLYFVFLFYPFLPEVSKFLFHLSLD

SEQ ID NO: 31 - protein, 420 aa, Brachypodium distachyon
MKRSPPQPSPSPSSSPASSSSSPSSSDSSSSIAIPRKRARTAAAAAGGGKARAAAAKRPKKDGKDSGSSSNGGGGGGGKRSSIYRGVTRHRWTGRFEAHLWDKNCFTSLQNKKKGRQVYLGAYDTEEAAARAYDLAALKYWGPETTLNFSADDYGKERSEMEAVSREEYLAALRRRSSGFSRGVSKYRGVARHHHNGRWEARIGRVLGNKYLYLGTFDTQEEAARAYDLAAIQYRGANAVTNFDISRYLDQPQLLEQLQQQQGPQVVAALQEEAQRDHQSDNAVQELNSGEAQTPGGIDEPIAIGDSTEDINTSLTVDDIIEESLWSPYEFDIMAGVNVSNSMNLSELFSDVAFEGNIGCLFEECSGIDDCSSRHGAGLAAFGLFTEGDDKLKDVSEMEMEVNPQANDVSCPPKMITVCN

SEQ ID NO: 32 - protein, 423 aa, Hordeum vulgare
MKRSPPPQPSPSSSPACSPSPSSPSSSDSSSIAIPRKRARTQKAGSAKAKAAPKRAKKDSGRSTKDSDASANGAAASGKRSSIYRGVTRHRWTGRFEAHLWDKNCFTSIQNKKKGRQVYLGAYDTEEAAARAYDLAALKYWGPETTLNFTVDEYAKERSEMEAVSREEYLAALRRRSSGFSRGVSKYRGVARHHHNGRWEARIGRVLGNKYLYLGTFDTQEEAARAYDLAAIEYRGANAVTNFDISRYLDQPQLLAQLEQGPQVVPALQEELQHDHQSDNAVQELNSGEAQKPGSVSEPIAVDDTDNTGDIGAPLVFDSGVEENLWSPCMDYDVDPIFGPNISSSMNLSEWFNDPAFESNIGYMFEGCSDVDDCSTRHGAGLSALGFLKEGDDKLKDGSDMEAEITPQANDVSCPPKMITVCN

SEQ ID NO: 33 - protein, 443 aa, Oryza sativa
MAKRSSPDPASSSPSASSSPSSPSSSSSEDSSSPMSMPCKRRARPRTDKSTGKAKRPKKESKEVVDPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDGERISPQANNISCPQKMISVCN

SEQ ID NO: 34 - protein, 420 aa, Sorghum bicolor
MDMERSQQQKSPTESPPPPSPSSSSSSVSADTVLPPPGKRRRAATTAKAKAGAKPKRARKDAAAAADPPPPPAAAAAGKRSSVYRGVTRHRWTGRFEAHLWDKHCLAALHNKKKGRQVYLGAYDSEEAAARAYDLAALKYWGPETLLNFPVEDYSSEMPEMEGVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEAQPDQSETETIAQESVSSEAKTPDDNAEPDDNAEPDDIAEPLITVDDSIEESLWSPCMDYELDTMSRSNFGSSINLSEWFNDADFDSNIGCLFDGCSAVDEGGKDGVGLADFSLLEDFSLFEAGDGQLKDVLSDMEEGIQPPTMISVCN

SEQ ID NO: 35 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 36 - protein, 413 aa, Brachypodium distachyon
MEAYCSTLVKDELINGGGGGSAGGMRYCEAAPRVSPPVAIKSVKRRKREPPAVSGMTTVSGGGKDGDKSAGNAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSTINTNTPAAELAILGGGGTPAALITPPPTMHVPRLLPPLVKGRGSSIADDVSAGSCVFGGPSPSPSPTTTALSLLLRSSVFQELVAQQQPPSTVDDDDDIGGHAAVSDAAQRAAEENEESFGEVLYGAGEGEAATAFSCSMYELGLDDNFARIEESLWGCL

SEQ ID NO: 37 - protein, 423 aa, Brachypodium sylvaticum
MEAYCSSLVKDELINGGGGGAGGMRYCEAAPRVSPPVAIKSVKRRKREPPAVSGMTTVSGGGGGNGKDGDKSAGNAAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSAANTNTPPAAAAELAILGGAPAALISPAPAPTTMRVPRLLPPLVRGRGGSIPDDVSAGGSCVFGSPSPSPSPTTTSALSLLLRSSVFQELVAQQQPPSIVDDDDGVGGQEAVSDAAERAAEENEESFGEVLYGAGEGEAAAAFSCSMYELGLDDSFARIEESLWGCL

SEQ ID NO: 38 - protein, 399 aa, Oryza sativa
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 39 - protein, 488 aa, Sorghum bicolor
METYSLQVKDELHGGGIGIGGGGQGLYCGATPRPAAPAATGGGGGGGDGAVKSNKRSRKREPPPPPPSSLVTMSNGGKDEAVAGSGDKSASSNSNASKRSSRFRGVSRHRWTGRFEAHLWDKGTWNPTQKKKGKQVYLGAYNEEDAAARAYDLAALKYWGPTTYTNFPVVDYERELKVMQNVSKEEYLASIRRKSNGFSRGVSKYRGVARHHHNGRWEARIGRVFGNKYLYLGTYSTQEEAARAYDIAAIEYRGINAVTNFDLSTYIRWLKPGGGVEDSAAGTPTSGVRAPGIPPASLSLQAGGLLQHPHGAAAGMLQVDVDDLYRGQLAAARGAALFSGGIDDVGSVYAAGSAGPSPTALCAGRPSPSPSPSSSTTALSLLLRSSVFQELVARNAGGGAAQQQQLVVADDDGAVSPADVVDAKVEQPEAEGELGRHGDQLYGAARADEDEDAFACSMYELDDSFARMEQSLWGCLRSSDAPDNMNNL

SEQ ID NO: 40 - protein, 443 aa, Sorghum bicolor
MESSGMMMVKSEIESCGYPGPSSSTAPAAGVVIGGSATTERGEGGHHHHHHQVVVRRRRREPPLLAPIAGGGIGKPLPSITVKRSSRFRGVSRHRWTGRFEAHLWDKNSWNPTQRKKGKQVYLGAYDEEEAAARAYDLAALKYWGPTTYTNFPVMDYEKELKIMENLTKEEYLASLRRKSSGFSRGVSKYRGVARHHQNGRWEARIGRVFGNKYLYLGTYSTQEEAARAYDIAAIEYKGVNAVTNFDLRSYITWLKPSGAPAAFNPEAALLMQAAPAEQLLHPAETAQMLPRVGNPFLLDHGAAPPGSSGGGGQDASMSSMVSPGAGGGMRRRGSSTALSLLLKSSMFRQLVEKNSDAEEGVRDREDAAAAAAAAHPAGPGDAYEYHNFFQGEAPPDMCDLFSSGGGGDHARNAGFHGEIAACYDDGEGLDGWNGFGNMSSLQ

SEQ ID NO: 41 - protein, 407 aa, Glycine max
MELAPVKSELSPRSHRLLMIDGSEVIGTKCVKRRRRDSSTAVLGGNGQQGEQLEEQKQLGGQSTATTVKRSSRFRGVSRHRWTGRFEAHLWDKGTWNPTQKKKGKQVYLGAYNDEEAAARAYDLAALKYWGISTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQPFATSNSMQARGNIEVSNSNKNSFPSGKLDSTKKRDFSKYMNPLSPCNKPSSPTALGLLLKSSVFRELMQRNLNSSSEEAEEVELKYPHEGNDGVGGIYDNENTNNSYFCSSNISRLPNLESSEESPLPMYHGTVQSLWNSAFNMSN

SEQ ID NO: 42 - protein, 406 aa, Glycine max
MELAPVKSELSPRSHRLVIIDGSDVISTKCAKRRRRDSSMAVLGGNGQQGEQLEEQKQLGGQSTATTVKRSSRFRGVSRHRWTGRFEAHLWDKGTWNPTQKKKGKQVYLGAYNDEEAAARAYDLAALKYWGTSTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQLFATSNSMQTRGNIEVSNSNMHSFPSGELDSTKKRDFSKYMNPLSPCNKPSSPTALGLLLKSSVFRELMQRNLNSSSEEADVELKYPQEGNDGVGGIYDNDNTSNSYFCSSNISRLPNLESSEECPLPMYHGTMQSLWNSAFNMSN

SEQ ID NO: 43 - protein, 418 aa, Populus trichocarpa
MEMTRNTGDQISLGRRRLCMIEEERRAGEAGKCIKRRRRDPSTFALSCNINDQQSDQQQQQQSLGDRTAAVATTVKRSSRFRGVSRHRWTGRFEAHLWDKGTWNPTQRKKGKQGAYDEEESAARAYDLAALKYWGTSTFTNFPASDYEKEIEIMKTVTKEEYLASLRRRSSGFSRGVSKYRGVARHHHNGRWEARIGRVFGNKYLYLGTYSTQEEAAHAYDIAAIEYRGINAVTNFDLSTYIRWLKPEASLPAPQTQESKPASDPLPMATFSNHLPSEKPTQLSVLQMDPSLMDNLNTPKNEDIFHRKTLPVSPLTRSSSSTALSLLFKSSIFKELVEKNLNTTSEEIEENDSKNPHNGNNNAGEAFYDGLSPIPHTGTSTEDPFLCSEQGETNTLPPYSGMEQSLWNGALSMPSRFH

SEQ ID NO: 44 - protein, 336 aa, Vitis vinifera
MEMTTVKSELGLERGRLCTAETDALEVTKCVKRRRRDPSAVTPGCSKQGEQQKQVLLQAGQSITAIATTMKRSSRFRGVSRHRWTGRFEAHLWDKGSWNVTQRKKGKQVYLGAYDEEESAARAYDLAALKYWGPSTFTNFPVSDYEKEIEIMQGLTKEEYLASLRRRSSGFSRGVSKYRGVARHHHNGRWEARIGRVFGNKYLYLGTYSTQEEAAHAYDIAAIEYRGINAVTNFELSTYVRWLRPRATALTPQEPRSNSIMQASSNCLPNEEVELSFLSPNPFTVDDLATPLKQEKFQREVSISPCTKSSSPTALSLLHRSSVFRQLVEKNSNSIE

SEQ ID NO: 45 - protein, 389 aa, Glycine max
MAMMKENIIEVSLGRRQMSMTEGEFQGTRSVKRRRREVAAAAGSGDDNHQQQLPQQEVGENTTVNTTKRSSRFRGVSRHRWTGRYEAHLWDKLSWNITQKKKGKQGAYDEEESAARAYDLAALKYWGTSTFTNFPISDYEKEIQIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTLEANLESHAALEHQKVASPSNYALTEESKSLALHNSFFSPYSLDSPVKHERFGNKTYQFSSNKSSSPTALGLLLRSSLFRELVEKNSNVSGEEDDGEATKDQQTQIATDDDLGGIFFDSFSDIPFVCDPNRYDLELQERDLHSIF

SEQ ID NO: 46 - protein, 389 aa, Glycine max
MVMMKENIIEEKLGRSQMSMVEGEFQGTWGVKRRRREVAAAASSGDDNHHQQLPQQEVGENSSISTTKRSSRFRGVSRHRWTGRYEAHLWDKLSWNITQKKKGKQGAYDEEESAARAYDLAALKYWGNSTFTNFPISDYEKEIEIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTPEENLESHAVLEHQKLASPSNYALTEESKSLVLPNSFISPDSLDSPVKHESFGNKTYQFSRNKSSSPTALGLLLRSSLFRELVEKNSNVSGEEADGEVTKDQQPQLASDDDLDGIFFDSFGDIPFVCDPTRYNLELQERDLHSIF

SEQ ID NO: 47 - protein, 392 aa, Medicago truncatula
MAMLIENEVMCLGKSQRSMDGKEVKGARRVKRQRRDAIVPKIGDDANKMAQKQVGENSTTNTSKRSSRFRGVSRHRWTGRFEAHLWDKLSWNTTQKKKGKQGAYDEEESAARAYDLAALKYWGTSTFTNFPISDYDKEIEIMNTMTKEEYLATLRRKSSGFSRGVSKYRGVARHHHNGRWEARIGRVFGNKYLYLGTYSTQEEAARAYDIAAIEYRGIHAVTNFELSSYIKWLKPETTTEENHESQILQKESRTLAPPNNSTLLQESKLLALQKSFFIPNDLNSTEKQESSFENKNYHFLSNKSTSPTALSLLLRSSLFRELLEKNSNVSEDEVTKEQQQQQITSDDELGGIFYDGIDNISFDFDPNSCNIELQERDLHSISCLYQYLNFGQ

SEQ ID NO: 48 - protein, 386 aa, Populus trichocarpa
MMMIKNEENPGRRRGCIADSEAQVARCVKRRRRDPAIVALGSDDNQSQQQMPQKQTDQTSAATTVKRSSRFRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWIKPGVAAQAAANELQTVTDPQTAATLTDTYTPREETKPSLFLPNQFTADYLNSPPKLDAFQNNIFVDSSNKTSSPTALSLLLRSSVFRELVEKNSNVCEEETDGNEIKNQPMAGSDDEYGGIFYDGIGDIPFVYSSNKYSLGLEERELQFVL

SEQ ID NO: 49 - protein, 372 aa, Ricinus communis
MEMMMVKNEEISGRRRASVTESEAYVARCVKRRRRDAAVVTVGGDDSQSHQQQQQQQPEQQAHQISAATTVKRSSRYRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWLKPEVAAQVAANEPQTVAESRMLPSINNRIAREESKPSFFSATPFSLDCWSYPRKQEEFQNRTPITPCSKTSSPTALSLLLRSSIFRELVEKNSNVSEDENEGEETKNQSQIGSDDEFGGLFYERIGDIPFI

SEQ ID NO: 50 - protein, 404 aa, Vitis vinifera
MEMMRVKSEENLGRRRMCVADAEAQGTRCVKRRRRDPAIVTLGCDDQSQQQQLPNQQPDQASAATTVKRSSRFRGVSRHRWTGRFEAHLWDKFSWNVTQKKKGKQGAYDEEESAARAYDLAALKYWGASTFTNFPVSDYEKEIEIMQSVTKEEYLACLRRKSSGFSRGVSKYRGVARHHHNGRWEARIGRVFGNKYLYLGTYSTQEEAARAYDIAAIEYRGINAVTNFDLSTYIRWLNPAANNPVVPHESRANTEPQALASSNFVLSEESEPLFFHSNSFTMDDLNPPHKQEVFQTKIPIEPCSKSSSPTALGLLLRSSIFRELVEKNSNAPEDETDAEDTKNQQQVGSDDEYGIFYDGIGDIPFVCPSNGDRNELQERLPLPFTISQGNPYGTAVLTSMQSIN

SEQ ID NO: 51 - protein, 378 aa, Brachypodium distachyon
MAKQRTDSAGTDAAAVQLTKPKRTRKSVPRRESPSRRTSAYRGVTRHRWTGRFEAHLWDKNTWTQSQRKKKGRQVYLGAYGGEEAAARAYDLAALKYWGRDTVLNFPLSNYDEEWKEMEGQSREEYIGSLRRKSTGFSRGVSKYRGVARHHHNGKWEARIGRVYGNKYLYLGTYGTQEEAAMAYDIAAIEHRGLNAVTNFDVSRYIDWHRRLCRDLGDNIITPLTNPTVDLEEAMAGDDDDGQFLLPSQATTPPSTSSALGLLLLSPRLKEVIEGSGAASAMAASTSESSAAGSPPPSWSSSSCSPSPPSPSHSPPETQQKQQQQEYGASAAAARCSFPDDVQTYFGCEDGCAEVDTFLFGDLSAYAAPMFQFELLDV

SEQ ID NO: 52 - protein, 416 aa, Oryza sativa
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 53 - protein, 440 aa, Sorghum bicolor
MARPRKNAGTDEDNPNAATGVSVTGKPPKLKRVRRKGEPRESSTPSQRSSAYRGVTRHRWTGRFEAHLWDKDARNGSRNKKGKQGAYDDEEAAARAHDLAALKYWGPATVLNFPLCGYDEELREMEAQPREEYIGSLRRRSSGFSRGVSKYRGVARHHHNGRWEARIGRVLGNKYLYLGTFATQEEAAVAYDIAAIEHRGLNAVTNFDISHYVNHWHRHCHGPSDDSLGVVVDDVAAFQLPDDLPECPAAAIGVEETTGGDAEFHNGEEGYLQHHTSGPFGAQQQLPDETGALAAHQMAPNSSALDMVLQSPKFKELMEQVSAAAAAVASESSIGGSMSSSSPSPSLSSFSPSPLQLPSPSSLSSFSPSSPLQQPSPPLQQPEFVEGAPAARCSFPDDVQTFFDFENESDMSFMYAEVDTFLFGDLGAYAAPIFHFDLDV

SEQ ID NO: 54 - protein, 408 aa, Zea mays
MARPRKNGGTDEDDANAATGATGKPKKLMKRARRKSESPSPRSSAYRGVTRHRWTGRFEAHLWDKDARNGSRSKKGKQVYLGAYDDEDAAARAHDLAALKYWGPAGTVLNFPLSGYDEERREMEGQPREEYVASLRRRSSGFARGVSKYRGVARHHHNGRWEARIGRVLGNKYLYLGTYATQEEAAVAYDMAAIEHRGFNAVTNFDISHYINHWHRHCHGPCDGSLGAMDVAPNVSLELDLLECPATVGLGLEETTGDDEFHNREDYLGHLFGVQQLPDEMGPPAHQMAPASSALDLVLQSPRFKELMQQVSAAGASETNGGSMRSSPSTSLCSFSPSPLELPSPPLQQPTEFIDGAPPRCSFPDDVQSFFDFKNDNDMSFVYAEVDTFLFGDLGAYAPPMFDFDLYE

SEQ ID NO: 55 - protein, 304 aa, Arabidopsis lyrata
MAKVSRRSKKTIVEDEISDKTASASEAASIVFKSKRKRKSPPRNAPPQRSSPYRGVTRHRWTGRYEAHLWDKNSWNETQTKKGRQVYIGAYDEEEAAARAYDLAALKYWGRDTLLNFPLLIYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPDAADSKPIRNDPESSDDNKCPKSEEIIEPSTSPEAITTRRSFPDDIQTYFGCQDSGKLATEEDVIFGGLNSFINPGFYNEFDYGP

SEQ ID NO: 56 - protein, 308 aa, Arabidopsis thaliana
MAKVSGRSKKTIVDDEISDKTASASESASIALTSKRKRKSPPRNAPLQRSSPYRGVTRWTGRYEAHLWDKNSWNDTQTKKGRQGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 57 - protein, 303 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 58 - protein, 332 aa, Arabidopsis lyrata
MEEITRKSKKTSVENETGDDQSATSVVVKAKRKRRSQPRDAPPQRSSVHRGVTRHRWTGRYEAHLWDKNSWNETQSKKGRQGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYMKLPVPENPIDAANNLLESPHSDSSPFINPTHESDLSQSQSSSDDNDDRKTKLLKSSPLNAEEVIGPSTPPEIAPPRRSFPEDIQTYFGCQNSGKLTTEEDDVIFGDLDSFLTPDFYSELNDC

SEQ ID NO: 59 - protein, 328 aa, Thellungiella halophila
MAKVSQRSKKTIVNDEISDKKAVAVASVSSSAFLKSKRKRKLPPQNAPPQRSSSYRGVTRHRWTGRYEAHLWDKNCWNETQTKKGRQVYLGAYDEEEAAARAYDLAALKYWGRDTLLNFPLPTYEEDVKEMEGHSREEYIGSLRRKSSGFSRGVSKYRGVARHHHNGRWEARIGRVFGNKYLYLGTYATQEEAARAYDIAAIEYRGLNAVTNFDVSRYLNLPESKNPSAAANHLPDESDYYDSMPVRNPNHEPRSPDGQTSSEDNDYTKTEETLDPEAIPSRRSFPDDIQTYFGCQDSGKLATEEDVIFGGFNSFINPGFYNDFDYAP

SEQ ID NO: 60 - protein, 345 aa, Arabidopsis thaliana
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 61 - protein, 299 aa, Glycine max
MAKKSQKSLKNNNNNNTTRKRTRKSVPRDSPPQRSSIYRGVTRHRWTGRYEAHLWDKNCWNESQSKKGRQVYLGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAIEYRGLNAVTNFDLSRYINWPRPKTEENHQNTPSNQNVNSNAELELGSASDEITEEGVARSSESESNPSRRTFPEDIQTIFENNQDSGIYIENDDIIFGDLGSFGAPIFHFELDV

SEQ ID NO: 62 - protein, 393 aa, Brachypodium distachyon
MAKPRKNSAAANNNNNDNSTNANNAVAEAAAADVRAKPKKRTRKSVPRESPSQRSSIYRGVTRHRWTGRFEAHLWDKNSWNESQNKKGKQVYLGAYDEEEAAARAYDLAALKYWGPDTILNFPLSVYDDELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGGGVDSAAAAAARNPHPMLAGLATQEELPAIDHLLDGMAFQQHGLHSSSAAAAAAQEFPLPPALGHAPTTSALSLLLQSPKFKEMIERTSAAETTTTATTTSSSSSPRPAASPQCSFPEDIQTFFGCDDGVGVGVGAVGYTDVDGLFFGDLSAYASSTAFHFELDL

SEQ ID NO: 63 - protein, 379 aa, Oryza sativa
MAKPRKNSTTTNTSSSGVAAAAAAAAVKPKRTRKSVPRESPSQRSSVYRGVTRHRWTGRFEAHLWDKNSWNESQNKKGKQVYLGAYDDEEAAARAYDLAALKYWGPDTILNFPLSAYEGELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGADGAGAAQNPHPMLGALSAQDLPAIDLDAMASSFQHDGHGAAAAAAQLIPARHSLGHTPTTSALSLLLQSPKFKEMIERTSAAETTTTSSTTTSSSSPSPPQATKDDGASPQCSFPKDIQTYFGCAAEDGAAGAGYADVDGLFFGDLTAYASPAFHFELDL

SEQ ID NO: 64 - protein, 398 aa, Sorghum bicolor
MAKPRKNSAAANNNNSSSNGAGDLTPRAKPKRTRKSVPRESPTQRSSVYRGVTRHRWTGRFEAHLWDKNSWNESQNKKGKQVYLGAYDDEEAAARAYDLAALKYWGPDTILNFPASAYEGEMKGMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGAGGMAAAAAAAQNPHPMLGGLAQQLLLPPPADTTTTDGAGAAAFQHDHHGAEAFPLPPRTSLGHTPTTSALSLLLQSPKFKEMIQRTESGTTTTTTTTSSLSSSPPPTPSPSPPRRSPAPTQPPVQAAARDASPHQRGFPEDVQTFFGCEDTAGIDVEALFFGDLAAYATPAFHFEMDL

SEQ ID NO: 65 - protein, 396 aa, Zea mays
MARPRKNSAAAANNNNSNTTNAGNAAVDLAARVKPKRTRKSVPRESPSQRSSVYRGVTRHRWTGRFEAHLWDKNSWNESQNKKGKQVYLGAYDDEDAAARAYDLAALKYWGPDTILNFPASAYEAELKEMEGQSREEYIGSLRRKSSGFSRGVSKYRGVARHHHNGRWEARIGRVFGNKYLYLGTYGTQEEAAMAYDMAAIEYRGLNAVTNFDLSRYIKWLRPGAGAAQNPHPMLDGLAQQLLLSPEGTIDGAAFHQQQHDHRQQGAAELPLPPRASLGHTPTTSALGLLLQSSKFKEMIQRASAAESGTTTVTTTSSSSSQPPTPTPTPSPSPPPTPPVQPARDASPQCSFPEDIQTFFGCEDVAGVGAGVDVDALFFGDLAAYASPAFHFEMDL

SEQ ID NO: 66 - protein, 362 aa, Glycine max
MAKKSQLRTQKNNATNDDINLNATNTVITKVKRTRRSVPRDSPPQRSSIYRGVTRHRWTGRYEAHLWDKHCWNESQNKKGRQGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNTNSNNDQISINLTNINNNCTNNFIPNPDQEQEVSFFHNQDSLNNTIVEEATLVPHQPRPASATLALELLLQSSKFKEMVEMTSVANLSTQMESDQLPQCTFPDHIQTYFEYEDSNKYEEGDDLLFKFSEFSSIVPFYHCDEFES

SEQ ID NO: 67 - protein, 370 aa, Glycine max
MAKKSQLRTQKNNVTTNDDNNLNVTNTVTTKVKRTRRSVPRDSPPQRSSIYRGVTRHRWTGRYEAHLWDKHCWNESQNKKGRQVYLGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNNTNNVIDDQISINLTNINNNNNCTNSFTPSPDQEQEASFFHNKDSLNNTIVEEVTLVPHQPRPASATSALELLLQSSKFKEMMEMTSVANLSSTQMESELPQCTFPDHIQTYFEYEDSNRYEEGDDLMFKFNEFSSIVPFYQCDEFES

SEQ ID NO: 68 - protein, 356 aa, Medicago truncatula
MAKKSQKQIEKDDNASNDNDNLNPSNTVTTKAKRTRKSVPRTSPPQRSSIYRGVTRHRWTGRYEAHLWDKNCWNESQNKKGRQGAYDNEETAAHAYDLAALKYWGQDTIINFPLSNYQKELIEMESQSREEYIGSLRRKSSGFSRGVSKYRGVARHHHNGRWEARIGKVFGNKYLYLGTYATQEEAATAYDMAAIEYRGLNAVTNFDLSRYIKWLKPNNNNNDDNNKSNINLCDINSNSSANDSNSNEELEFSLVDNEISLNNSIDEATLVQPRPTSATSALELLLQSSKFKEMVEMASMTSNVSTTLESDQLSQCAFPDDIQTYFEYENFNDTMLEDLNSIMPTFHYDFEGAEVL

SEQ ID NO: 69 - protein, 347 aa, Glycine max
MAKQQTHKINASTNNNISTTNTVTAKVKRTRRSVPRDSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGVNAVTNFDLSRYIKWLKPNNNNTTVNSNLIDSNPNCETNFTSNSNQQQGFNFFNRQESFNNEEAAMTQPRPAVATSALGLLLQSSKFKEMMEMTSATDLSTPPSESELPSCTFPDDIQTYFECEDSHRYGEGDDIMFSVLNGFVPPMFHCDDF

SEQ ID NO: 70 - protein, 351 aa, Glycine max
MAKQQTHEINASTNNNINTTKTVTTKVKRTRRSVPRNSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGLNAVTNFDLSRYIKWLKPNNNNNKVNSNNLIVSIPNCATNFTPNSNQQQGFNFFNSQESFNNNEEAAMTQPRPAAATSALGLLLQSSKFKEMMEMTSAIDLSTPPSESELPPCTFPDDIQTYFECEDSHRYGEGDDIMFSELNGFVPPMFHCDDFEA

SEQ ID NO: 71 - protein, 353 aa, Populus trichocarpa
MAKLSQKNTKNTASNNNNTTNGVTKVKRTRRSVPRDSPPQRSSIYRGVTRHRWTGRYEAHLWDKNCWNESQNKKGRQGAYDDEEAAAHAYDLAALKYWGPETILNFPLSTYQNELKEMEGQSREECIGSLRRKSSGFSRGVSKYRGVARHHHNGRWEARIGRVFGNKYLYLGTYATQEEAATAYDMAAIEYRGLNAVTNFDLSRYIKWLKPNQNNTDNNNGLDLPNPIIGTDNSTHPNPNQELGTTFLQINQQTYQPSETTLTQPRPATNPSSALGLLLQSSKFKEMMEMTAVTDCPPTPPSGLDPTPCSFLEDVQTYFDCLDSSNYGDQGDDMIFGDLNSFVPPMFQCDFET

SEQ ID NO: 72 - protein, 323 aa, Vitis vinifera
MAKLSQQNHKNSANSNATNTTLSVTKVKRTRKTVPRDSPPQRSSIYRGVTRHRWTGRYEAHLWDKNCWNESQNKKGRQVYLGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACKMMEMTTAADHLSTPPESELPRCSFPDDIQTYFECQDSGSYEEGDDVIFSELNSFIPPMFQCDFSA

SEQ ID NO: 73 - protein, 347 aa, Vitis vinifera
MAKLSQQNHKNSANSNATNTTLSVTKVKRTRKTVPRDSPPQRSSIYRGVTRHRWTGRYEAHLWDKNCWNESQNKKGRQGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACSEPPLTQTRPPIASSALGLLLQSSKFKEMMEMTTAADHLSTPPESELPRCSFPDDIQTYFECQDSGSYEEGDDVIFSELNSFIPPMFQCDFSA

SEQ ID NO: 74 - protein, 275 aa, Populus trichocarpa
MGKTSKQSLKNSANTSINPATKVKRTRKSVPRDSPPQRSSIYRGVTRHRWTGRYEAHLWDKNCWNESQNKKGRQGAYDDEEAAGHAYDLAALKYWGQDTILNFPLSTYEEEFKEMEGHSKEEYIGSLRRKSSGFSRGVSKYRGVARHHHNGRWEARIGRVFGNKYLYLGTYATQEEAATAYDMAAIEYRGLNAVTNFDLSRYSSKFKEMLERTSASDCPLTPPESDRDPPRRSFPDDIQTYFDCQDSSSYTDGDDIIFGDLHSFASPIFHCELDG

SEQ ID NO: 75 - protein, 304 aa, Vitis vinifera
MAKTSQKSQKTTGNSTNNNGGSVAKVKRTRKSVPRDSPPQRSSIFRGVTRHRWTGRYEAHLWDKNCWNESQNKKGRQVYLGAYDDEEAAAHAYDLAALKYWGQETILNFPLSAYQEELKEMEGQSKEEYIGSLRRKSSGFSRGVSKYRGVARHHHNGRWEARIGRVFGNKYLYLGTYATQEEAATAYDMAAIEYRGLNAVTNFDLSRYINSPAPNPNPSDHELGLSFLQQQHGSDATELPLSHARSDCPLTPPDQIEMPRSSFPDDIQTYFDCQETNSYGESDDIIFGDLKYFSSPMFQCELDT

SEQ ID NO: 76 - protein, 393 aa, Sorghum bicolor
MASPNPEAAAGLQTVAVAAGGGEGGSSSSLGAVAGAAAVSSSGELVPRRSLAVRKERVCTAKERISRMPPCAAGKRSSIYRGVTRHRWTGRYEAHLWDKSTWNQNQNKKGKQGAYDDEEAAARAYDLAALKYWGAGTQINFPVSDYARDLEEMQMISKEDYLVSLRRQLHNSRWDTSLGLGNDYMSLSCGKDIMLDGKFAGSFGLERKIDLTNYIRWWLPKKTRQSDTSKTEEIADEIRAIESSMQQTEPYKLPSLGLGSPSKPSSVGLSACSILSQSDAFKSFLEKSTKLSEECTLSKEIVEGKTVASVPATGYDTGAININMNELLVQRSTYSMAPVMPTPMKTTWSPADPSVDPLFWSNFVLPSSQPVTMATITTTTNEVSSSDPFQSQE

SEQ ID NO: 77 - protein, 428 aa, Lupinus angustifolius
MASSSSDPGKSEIGGGAAETSEAAAVAVAVTNDQSLLYRGLKKAKKERGCTAKERISKMPPCAAGKRSSIYRGVTRHRWTGRYEAHLRDKSTWNQNQNKKGKQVYLGAYDDEEAAARAYDLAALKYWGPGTLINFPVTDYTRDLEEMQNVSREEYLASLRRKSSGFSRGISKYRALSSRWEPSYSRFAGSDYFNSMHYGAGDDSAAESEYASGFCIERKIDLTGHIKWWGSNKSRQPDAGTRLSEEKRHGFAGDICSEPKTLEQKVQPTEPYQMPELGRSHNEKKHRSSAVSALSILSQSAAYKSLQEKASKKQENSTDNDENENKNTVNKLDHGKAVEKSSNHDGGSDRVDIEIGTTGALSLQRNIYPLTPFLSAPLLTAYNTVDPSLVDPVLWTSLVPMLSAGLSCPTQVTKTETSSSYTIFQPEG

SEQ ID NO: 78 - protein, 440 aa, Ricinus communis
MASSSSDPGLKPELGGGSGGESSEAVIANDQLLLYRQLKKPKKERGCTAKERISKMPPCTAGKRSSIYRGVTRHRWTGRYEAHLWDKSTWNQNQNKKGKQGAYDDEEAAARAYDLAALKYWGPGTLINFPVTDYSRDLEEMQNVSREEYLASLRRKSSGFSRGISKYRGLSSQWDSSFGRMPGSEYFSSINYGAADDPAAESEYVGSLCFERKIDLTSYIRWWGFNKTRESVSKSSDERKHGYGEDISELKSSEWAVQSTEPYQMPRLGMPDNGKKHKCSKISALSILSHSAAYKNLQEKASKKQENCTDNDEKENKKTNKMDYGKAVEKSTSHDGSNERLGAALGMSGGLSLQRNAYQLAPFLSAPLLTNYNAIDPLVDPILWTSLVPVLPAGFSRNSEVGMGLQIVSCHKDRDKFNLYLLSAGGVSTFLLLVVHWRFC

SEQ ID NO: 79 - protein, 428 aa, Lupinus angustifolius; identical to SEQ ID NO: 77

SEQ ID NO: 80 - protein, 508 aa, Aspergillus fumigatus
MKMSASKTVTSSASAVSTSSGRSTPSKLVNGATRNGSAAAGNGSTGTAKGKRRSKYRHVAAYHSELRHSSLSRETSVVPSFLGFRNLMVIVLVAMNLRLIIENFMKYGVLICIKCHDYRKQDVVLGSILFALVPCHLFLAYIIELVAAQQSKKTVGRQKKDLSTEEREREQQAFRSTWRYTAFFHTVNATLCLAVTSFVVYFYINHPGIGTICELHAIIVWLKNCSYAFTNRDLRQAMVDPSAESALPEIYSTCPYPRNITLGNLTYFWLAPTLVYQPVYPRSSHIRWSFVAKRLAEFFGLAVFIWLLSAQYAAPVLRNSIDKIAVMDIASILERVMKLSTISLVIWLAGFFALFQSLLNALAEVMRFGDREFYTDWWNSPSLGAYWRSWNRPVYLFMKRHVFSPLVGRGWSPFAASFMVFSLSAVLHEMLVGIPTHNLIGVAFAGMMFQLPLIAVTAPFEKVNDALGKIVGNSIFWVSFCLVGQPLGALLYFFAWQAKYGSVSKIHV

SEQ ID NO: 81 - protein, 521 aa, Ricinus communis
MTILETPETLGVISSSATSDLNLSLRRRRTSNDSDGALADLASKFDDDDDVRSEDSAENIIEDPVAAVTELATAKSNGKDCVANSNKDKIDSHGGSSDFKLAYRPSVPAHRSLKESPLSSDLIFKQSHAGLFNLCIVVLVAVNSRLIIENLMKYGWLIKTGFWFSSRSLRDWPLFMCCLSLPVFPLAAYLVEKAAYRKYISPPIVIFLHVIITSAAVLYPASVILSCESAFLSGVTLMELACMVWLKLVSYAHTNYDMRAIADTIHKEDASNSSSTEYCHDVSFKTLAYFMVAPTLCYQPSYPRTAFIRKGWVFRQFVKLIIFTGFMGFIIEQYINPIVQNSQHPLKGDLLYAIERVLKLSVPNLYVWLCLFYCFFHLWLNIVAELLRFGDREFYKDWWNAKTVEEYWRMWNMPVHKWMVRHIYFPCLRRKIPRGVAIVIAFFVSAVFHELCIAVPCHMFKLWAFFGIMFQIPLVVITNYFQRKFRSSMVGNMIFWFFFCILGQPMCVLLYYHDLMNRDGN

SEQ ID NO: 82 - protein, 526 aa, Vernicia fordii
MTIPETPDNSTDATTSGGAESSSDLNLSLRRRRTASNSDGAVAELASKIDELESDAGGGQVIKDPGAEMDSGTLKSNGKDCGTVKDRIENRENRGGSDVKFTYRPSVPAHRALKESPLSSDNIFKQSHAGLFNLCIVVLVAVNSRLIIENIMKYGWLIKTGFWFSSRSLRDWPLLMCCLTLPIFSLAAYLVEKLACRKYISAPTVVFLHILFSSTAVLYPVSVILSCESAVLSGVALMLFACIVWLKLVSYAHTNFDMRAIANSVDKGDALSNASSAESSHDVSFKSLVYFMVAPTLCYQPSYPRTASIRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLITFFVSAVFHELCIAVPCHIFKLWAFIGIMFQIPLVGITNYLQNKFRSSMVGNMIFWFIFCILGQPMCLLLYYHDLMNRKGTTESR

SEQ ID NO: 83 - protein, 523 aa, Vernonia galamensis
MALLDTPQIGEITTTATTTIRRRTTVKPDAGIGDGLFDSSSSSKTNSSFEDGDSLNGDFNDKFKEQIGAGDESKDDSKGNGQKIDHGGVKKGRETTVVHYAYRPSSPAHRRIKESPLSSDAIFKQSHAGLFNLCIVVLVAVNGRLIIENLMKYGLLINSNFWFSSRSLRDWPLLMCCLTPSDFPLAAYIVEKLAWKKRISDPVVITLHVIITTTAILYPVFMILRFDSVVLSGVSLMLCACINWLKLVSFVHTNYDMRSLLNSTDKGEVEPMSSNMDYFYDVNFKSLVYFMVAPTLCYQISYPRTAFIRKGWVLRQLIKLVIFTGFMGFIIEQYINPIVKNSRHPLKGDFLYAIERVLKLSVPNLYVWLCMFYCFFHLWLNILAELLCFGDREFYKDWWNAQTIEEYWRLWNMPVHKWIVRHLYFPCLRNGIPKGAAILVAFFMSAVFHELCIAVPCHIFKFWAFIGIMFQVPLVLLTNYLQHKFQNSMVGNMIFWCFFSIFGQPMCVLLYYHDVMNQKGKSK

SEQ ID NO: 84 - protein, 517 aa, Vernonia galamensis
MALLDTPQIGEITTTATTTIRQHPLGKPDAGIGDGLFSSSSSKTNSSFEDGDSLNGDFNDKFKEQIGAGDESKKGNGKIDHGGVKKGRETTVVHYAYRPSSPAHRRIKESPLSSDAIFKQSHAGLFNLCIVVLVAVNGRLIIENLMKYGLLINSKFWFSSRSLRDWPLLMCWLTPSDFPLAAYIVEKLAWKKRISDPVVITLHVVITTTAILYPIFMILRFDSVVLLGVSLMLCACINWLKLVSFVHTNYDMRSLLNSTGKGEVEPMSSNMDYFYDINFKSLVYFMVAPTLCYQISYPRTAFIRKGWVFRQLIKLVIFTGFMGFIIEQYINPIVKNSRHPLNGDFLYAIERVLKVSVPNLYVWLCMFYCFFHLWLNILAELLWFGDREFYKDWWNTQTIEEYWRLWNMPVHKWIVRHLYFPCLRNGISKGAAILVAFFMSAVFHELCIAVPCHILKFWAFIGIMFQVPLVLLTNYLQHKFQNSMVGNMIFWCFFSIFGQPMCVFLYYHEVNQKGKSK

SEQ ID NO: 85 - protein, 507 aa, Euonymus alatus
MAANLNEASDLNFSLRRRTGGISSTTVPDSSSETSSSEADYLDGGKGAADVKDRGDGAVEFQNSMKNVERIEKHESRVGLDSRFTYRPSVPAHRTIKESPLSSDAIFKQSHAGLFNLCIVVLVAVNSRLIIENLMKYGWLIRSGFWFSSRSLRDWPLFMCCLTLPVFPLAAFLFEKLAQKNLISEPVVVLLHIVNTTAAVLYPVLVILRCDSAFMSGVTLMLFACIVWLKLVSYAHTNYDMRALTKSVEKGDTPLSSQNMDYSFDVNIKSLAYFMVAPTLCYQISYPRTPYVRKGWVVRQFVKLIIFTGLMGFIIEQYINPIVQNSQHPLKGNFLYAIERVLKLSVPNLYVWLCMFYCLFHLWLNILAELLCFGDREFYKDWWNAKTVEEYWRMWNMPVHKWMVRHIYFPCLRNGIPKGVAFVISFLVSAVFHELCIAVPCHIFKLWAFFGIMLQVPLVLITSYLQNKFRSSMVGNMMFWFSFCIFGQPMCLLLYYHDLMNRNGKME

SEQ ID NO: 86 - protein, 498 aa, Caenorhabditis elegans
MQMRQQTGRRRRQPSETSNGSLASSRRSSFAQNGNSSRKSSEMRGPCEKVVHTAQDSLFSTSSGWTNFRGFFNLSILLLVLSNGRVALENVIKYGILITPLQWISTFVEHHYSIWSWPNLALILCSNIQILSVFGMEKILERGWLGNGFAAVFYTSLVIAHLTIPVVVTLTHKWKNPLWSVVMMGVYVIEALKFISYGHVNYWARDARRKITELKTQVTDLAKKTCDPKQFWDLKDELSMHQMAAQYPANLTLSNIYYFMAAPTLCYEFKFPRLLRIRKHFLIKRTVELIFLSFLIAALVQQWVVPTVRNSMKPLSEMEYSRCLERLLKLAIPNHLIWLLFFYTFFHSFLNLIAELLRFADREFYRDFWNAETIGYFWKSWNIPVHRFAVRHIYSPMMRNNFSKMSAFFVVFFVSAFFHEYLVSVPLKIFRLWSYYGMMGQIPLSIITDKVVRGGRTGNIIVWLSLIVGQPLAILMYGHDWYILNFGVSAVQNQTVGI

SEQ ID NO: 87 - protein, 498 aa, Rattus norvegicus
MGDRGGAGSSRRRRTGSRVSVQGGSGPKVEEDEVREAAVSPDLGAGGDAPAPAPAPAHTRDKDRQTSVGDGHWELRCHRLQDSLFSSDSGFSNYRGILNWCVVMLILSNARLSLENLIKYGILVDPIQVVSLFLKDPYSWPAPCLIIASNIFIVATFQIEKRLSVGALTEQMGLLLHVVNLATIICFPAAVALLVESITPVGSLFALASYSIIFLKLSSYRDVNLWCRQRRVKAKAVSAGKKVSGAAAQNTVSYPDNLTYRDLYYFIFAPTLCYELNFPRSPRIRKRFLLRRVLEMLFFTQLQVGLIQQWMVPTIQNSMKPFKDMDYSRIIERLLKLAVPNHLIWLIFFYWLFHSCLNAVAELLQFGDREFYRDWWNAESVTYFWQNWNIPVHKWCIRHFYKPMLRLGSNKWMARTGVFWASAFFHEYLVSIPLRMFRLWAFTAMMAQVPLAWIVNRFFQGNYGNAAVWVTLIIGQPVAVLMYVHDYYVLNYDAPVGA

SEQ ID NO: 88 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 89 - protein, 11 aa, Artificial Sequence
  conserved sequence
  X (4)..(4): Threonine (T) or Serine (S)
RGVXRHRWTGR

SEQ ID NO: 90 - protein, 8 aa, Artificial Sequence
  conserved sequence
  X (1)..(1): Phenylalanine (F) or Tyrosine (Y)
XEAHLWDK

SEQ ID NO: 91 - protein, 9 aa, Artificial Sequence
  conserved sequence
DLAALKYWG

SEQ ID NO: 92 - protein, 8 aa, Artificial Sequence
  conserved sequence
  misc_feature (2)..(2): Xaa can be any naturally occurring amino acid
  X (5)..(5): Serine (S) or Alanine (A)
  X (8)..(8): any amino acid
SXGFXRGX

SEQ ID NO: 93 - protein, 14 aa, Artificial Sequence
  conserved sequence
  X (3)..(3): Histidine (H) or Gutamine (Q)
  X (6)..(6): Arginine (R) or Lysine (K)
  X (12)..(12): Arginine (R) or Lysine (K)
  misc_feature (13)..(13): Xaa can be any naturally occurring amino acid
HHXNGXWEARIGXV

SEQ ID NO: 94 - protein, 9 aa, Artificial Sequence
  conserved sequence
  X (7)..(7): any amino acid
QEEAAAXYD

SEQ ID NO: 95 - protein, 165 aa, Brassica napus
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAVAPAAAPAAAPAPKPAAPPAPKPAAAPSI

SEQ ID NO: 96 - protein, 193 aa, Brassica napus
MADVRTHAHQVQVHPLRQQEGGIKVVYPQSGPSSTQVLAVIAGVPVGGTLLTLAGLTLAGSVIGLMLAFPLFLIFSPVIVPAAFVIGLAMTGFMASGAIGLTGLSSMSWVLNHIRRVRERMPDELEEAKQRLADMAEYVGQRTKDAGQTIEEKAHDVRESKTYDVRDRDTKGHTATGGDRDTKTTREVRVATT

SEQ ID NO: 97 - protein, 188 aa, Brassica napus
MANVDRRVNVDRTDKGLQLQPQYEDRVGYGYGYGGNTDYKSCGPSTNQIVALIAGVPIGGSLLALAGLTLAGSVIGFMLSIPLFLLFSPVIVPAALTIGLAVTGILASGLFGLTGLSSVSWVLNYIRGRSDTVPEQLDYAKRRMADAVGYAGQKGKEMGQYVQDKAHEAHDTSLTTETNGKTRRAHIA

SEQ ID NO: 98 - protein, 180 aa, Brassica napus
MADTARTHHDITSRDQYPILGRDRDQYPYGRSDYQTSGQDYSKTRQIAKAATAVTAGGSLLVLSSLTLVGTVIALTVATTLLVIFSPILVPALITVALLITGFLSSGGFGIADITVFSWIYKYATGEHPQGSDKLDSARMKLGTKAQDIKDRAQYYGQQHTGGEHDRDRTRGTHHTTTTT

SEQ ID NO: 99 - protein, 210 aa, Brassica napus
MADTHRVDRTDRHLQFQSPYEGGRVSIQYEGGGGAGGYGGRGGGYGAEGYKSMMPERGPSSTQVLSFLVGVPIVGSLLAIAGLLLAGSVIGLLISIPLFLLFSPVIVPAALTIGLAATGFLASGMFGLTGLSSVSWVLNYLRGTRKSSVPEQLEYAKKRMADAVGYAGQKGKGMGQHVQNKAQEAKQYDISKTHDTTTKGHETTQRTAAA

SEQ ID NO: 100 - protein, 149 aa, Brassica napus
MANQTRTHQDIIVRDSRITLDRDHPKTGAQMVKVATGVAAGGSLLVLSGLTLAGTVIAFAVATPLLIIFSPVLVPAVITVVLIITGFLASGGFGIAAITAFSWLYRHMTGSGSDQKIESARMKVGSRGYDTKYGQHNIGVHQQHQQAAS

SEQ ID NO: 101 - protein, 137 aa, Arachis hypogaea
MAEALYYGGRQRQEQPRSTQLVKATTAVVAGGSLLILAGLVLAGTVIGLTTITPLFVIFSPVLVPAVITVALLGLGFLASGGFGVAAITVLTWIYRYVTGKHPPGANQLDTARHKLMGKAREIKDFGQQQTSGAQAS

SEQ ID NO: 102 - protein, 150 aa, Arachis hypogaea
MTDRTQPHAVQVHTTAGRFGDTAAGTNRYADRGPSTSKVIAVITGLPIGGTLLLFAGLALAGTLLGLAVTTPLFILFSPVIVPATIVVGLSVAGFLTSGACGLTGLSSFSWVMNYIRQTHGSVPEQLEMAKHRMADVAGYVGQKTKDVGQ

SEQ ID NO: 103 - protein, 166 aa, Arachis hypogaea
MSDQTRTGYGGGGSYGSSYGGGGTYGSSYGTSYDPSTNQPIRQAIKFMTASTIGVSFLILSGLILTGTVIGLIIATPLLVIFSPILVPAAITLALAAGGFLFSGGCGVAAIAALSWLYSYVTGKHPAGSDRLDYAKGVIADKARDVKDRAKDYAGAGRAQEGTPGY

SEQ ID NO: 104 - protein, 176 aa, Arachis hypogaea
MATATDRAPHQVQVHTPTTQRVDVPRRGYDVSGGGIKTLLPERGPSTSQIIAVLVGVPTGGTLLLLSGLSLLGTIIGLAIATPVFIFFSPVIVPAVVTIGLAVTGILTAGACGLTGLMSLSWMINFIRQVHGTTVPDQLDSVKRRMADMADYVGQKTKDAGQEIQTKAQDVKRSSS

SEQ ID NO: 105 - protein, 153 aa, Ricinus communis
MADRPQPHQVQVHRYDPTTGYKGQQKGPSASKVLAVLTFLPVGGGLLSLSGITLTNTLIGMAIATPLFILFGPIILPAAVVIGLAMMAFMVAGALGLSGLTSQSWALKYFREGTAMPESLDQAKKRMQDMAGYVGMKTKEVGQDIQRKAQEGK

SEQ ID NO: 106 - protein, 138 aa, Ricinus communis
MAEHQQSPVVSHRPRVNQLVKAGTAATAGSSLLFLSGLTLTGTVIALALATPLMVLFSPVLLPAVIIISLIGAGFLTSGGFGFGAILVLSWIYRYVTGKQPPGAESLDQARLKLAGKAREMKDRAEQFGQHVTGQQTS

SEQ ID NO: 107 - protein, 226 aa, Glycine max
MTTQVPPHSVQVHTTTTHRYEAGVVPPGARFETSYEAGVKAASIYHSERGPTTSQVLAVLAGLPVGGILLLLAGLTLAGTLTGLAVATPLFVLFSPVLVPATVAIGLAVAGFLTSGAFGLTALSSFSWILNYIRETQPASENLAAAAKHHLAEAAEYVGQKTKEVGQKTKEVGQDIQSKAQDTREAAARDAREAAARDAREAAARDAKVEARDVKRTTVTATTATA

SEQ ID NO: 108 - protein, 223 aa, Glycine max
MTTVPPHSVQVHTTTHRYEAGVVPPARFEAPRYEAGIKAPSSIYHSERGPTTSQVLAVVAGLPVGGILLLLAGLTLAGTLTGLVVATPLFIIFSPVLIPATVAIGLAVAGFLTSGVFGLTALSSFSWILNYIRETQPASENLAAAAKHHLAEAAEYVGQKTKEVGQKTKEVGQDIQSKAQDTREAAARDARDAREAAARDARDAKVEARDVKRTTVTATTATA

SEQ ID NO: 109 - protein, 155 aa, Linum usitatissimum
MDQTHQTYAGTTQNPSYGGGGTMYQQQQPRSYQAVKAATAATAGGSLIVLSGLILTATVISLIIATPLLVIFSPVLVPALITVGLLITGFLASGGFGVAAVTVLSWIYRYVTGGHPAGGDSLDQARSKLAGKAREVKDRASEFAQQHVTGGQQTS

SEQ ID NO: 110 - protein, 180 aa, Linum usitatissimum
MADRTTQPHQVQVHTQHHYPTGGAFGRYEGVLKGGPYHQQGTGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFDQAKRRMQDAAGYMGQKTKEVGQEIQRKSQDVKASDK

SEQ ID NO: 111 - protein, 181 aa, Helianthus annuus
TTTTYDRHFTTTQPHYRQDDRSRYDQQTHSQSTSRTLAIIALLPVGGILLGLAALTFIGTLIGLALATPLFVIFSPIIVPAVLTIGLAVTGFLASGTFGLTGLSSLSYLFNMVRQTAGSVPESLDYVKGTLQDAGEYAGQKTKDFGQKIQSTAHEMGDQGQVGVHAQVGGGKEGRKSGDRT

SEQ ID NO: 112 - protein, 156 aa, Zea mays
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPAADQLDHAKARLASKARDVKDAAQHRIDQAQGS

SEQ ID NO: 113 - protein, 244 aa, Brassica napus
VSKPDDCRRIVDETISHFGRLDHLVNNAGIMQISMFENIEEITRTRAVMDTNFWGSVYTTRAALPYLRQSNGKIVAMSSSAAWLTAPRMSFYNASKAALLNFFETLRIELGSDVHITIVTPGYIESELTQGKYFSGEGELVVNQDIRDVQIGAFPVTSVSGCAKGIVKGVCRKQRYVTEPSWFKVTYLWKVFCPELIEWGCRLLFLSGHGTSEKNALNKKILDIPGVRSALYPESIRTPEIKSE

SEQ ID NO: 114 - protein, 349 aa, Brassica napus
MELINDFLNLTAPFFTFFGLCFFLPPFYFFKFVQSIFSTIFSENVYGKVVLITGASSGIGEQLAYEYASKGACLALTARRKNRLEEVAEIAREVGSPNVVTVHADVSKPDDCRRIVDETISHFGRLDHLVNNAGIMQISMFENIEEITRTRAVMDTNFWGAVYTTRAALPYLRQSNGKIVAMSSSAAWLTAPRMSFYNASKAALLNFFETLRIELGSDVHITIVTPGYIESELTQGKYVSGEGELVVNQDIRDVQIGAFPVTSVSGRAKGIVKGVCRKERYVTEPSWFKVTYLWKVFCPELIEWGCRLMFLSGHGTPEENALNKKILDIPGVRSALYPEPIRTPEIKSE

SEQ ID NO: 115 - protein, 456 aa, Brassica napus
MVDLLNSVMNLVAPPATMVVMAFSWPLLCFITFSERLYNSYFVTEDMEDKVVVITGASPAIGEQIAYEYAKRGANLVLVARREQRLRVVSNNARQIGANHVIIIAADVVKEDDCRRFITQAVNYYGRVDHLVNSASLGHTFYFDEVSDTTVFPHLLDINFWGNVYPTYVALPHLQKTNGRIVVNASVENWLPLPRMSLYSAAKAALVNFYETLRFELNGDVGITIATHGWIGSEMSRGKFMLEEGAEMQWKEEREVPANGGPLEEFAKMIVAGACRGDAYVKFPNWYDVFLLYRVFTPNVLRWTFKLLLSSEGSRQSSLVGVGQGLPPEESSSQMKLMLEGGSPRVTASPPRYTPSPSPPHHTASPPRYTPSPSPPHHTSSPQRYTPSPSPPHYTSSRHRYTPSPSPPHYTESPPLYTESPPHYTTSPNWYTESPPRYTPSPSPPRFSRFNIQELP

SEQ ID NO: 116 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 117 - protein, 350 aa, Zea mays
MLGMSRTGLAGAALRVALTALLPLVLPAYYVYKLTTYLLGAVFPEDVAGKVVLITGASSGIGEHLAYEYAKRGAYLALVARREASLREVGDVALGLGSPGVLVLPADVSKPRDCEGFIDDTISYFGRLDHLVNNASIWQVCKFEEIQDVRHLRALMDINFWGHVYPTRLAIPHLRRSRGRIVGVTSNSSYIFIGRNTFYNASKAAALSFYDTLRMELGSDIRITEVVPGVVESEITKGKMLTKGGEMKVDQDERDAILGPTPAEPVGDFARTVVRDVCRGARYVFEPRWYMGVYLLRACLPEVLAWNSRLLTVDTVGASTTDTLGKWLVELPGVRRVVQPPSLRSPEIKD

SEQ ID NO: 118 - protein, 245 aa, Brassica napus
MGTATEIMERDAMATVAPYAPVTFHRRARVDLDDRLPKPYMPRALQAPDREHPYGTPGHKNYGLSVLQQHVAFFDIDDNGIIYPWETYSGLRMIGFNIIGSLIIAAVINLALSYATLPGWLPSPFFPIYIHNIHKSKHGSDSRTYDNEGRFMPVNLELIFSKYAKTLPDKLSLGELWDMTEGQRDAWDIFGWFASKIEWGLLYLLARDEEGFLSKEAIRRCFDGSLFEYCAKIYVGINEDKTAYY

SEQ ID NO: 119 - protein, 244 aa, Brassica napus
MVRESMGEESEAFATTAPLAPVTGERKVRNDLEETLPKPYLARALVAPDTEHPNGSEGHDSKGMSVTQQHVAFFDQNGDGIVYPWETYAGFRDLGFNPISSVFWAIFINFAFSYVTLPSWLPSPLLPVYIDNIHKAKHGSDSSTYDTEGRYVPVNLENIFSKYALTAPNKITLKELWNLTEGNRMAIDPFGWLANKVEWLLVYLLAKDEEGFVSKEAVRGVFDASFFEYCAKKNKEKADSRKQD

SEQ ID NO: 120 - protein, 245 aa, Sesamum indicum
MATHVLAAAAERNAALAPDAPLAPVTMERPVRTDLETSIPKPYMARGLVAPDMDHPNGTPGHVHDNLSVLQQHCAFFDQDDNGIIYPWETYSGLRQIGFNVIASLIMAIVINVALSYPTLPGWIPSPFFPIYLYNIHKAKHGSDSGTYDTEGRYLPMNFENLFSKHARTMPDRLTLGELWSMTEANREAFDIFGWIASKMEWTLLYILARDQDGFLSKEAIRRCYDGSLFEYCAKMQRGAEDKMK

SEQ ID NO: 121 - protein, 243 aa, Zea mays
MSSYSPPPPPPRDQSMDTEAPNAPITRERRLNPDLQEQLPKPYLARALEAVDPSHPQGTKGRDPRGMSVLQQHAAFFDRNGDGVIYPWETFQGLRAIGCGLTVSFAFSILINLFLSYPTQPGWLPSPLLSIRIDNIHKGKHGSDSETYDTEGRFDPSKFDAIFSKYGRTHPNAITRDELSSMLQGNRNTYDFLGWLAAAGEWLLLYSLAKDKDGLLQRETVRGLFDGSLFERLEDDNNKKKSS

SEQ ID NO: 122 - DNA, 11142 bp, Artificial Sequence
  TDNA sequence
tcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtcc

SEQ ID NO: 123 - DNA, 16749 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattcactagtgattaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaaatcgaattcccgcggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 124 - DNA, 137 bp, Artificial Sequence
  linker sequence
atttaaatgcggccgcgaattcgtcgattgaggacgtccctactagacctgctggacctcctcctgctacttactacgattctctcgctgtgcatatggtcagtcatgcccgggcctgcaggcggccgcatttaaat

SEQ ID NO: 125 - DNA, 434 bp, Artificial Sequence
  hpRNAi
gtgagcaatgaaccaagatttatcaataccgttacttttgatagcaaagagggttctcctactcttgttatggtccacggatatggtgcctctcagggtttcttctttcggaatttttatgcccttgcgaggcatttcaaagttattgctattgatcagcttggctggggtggttcaagcaggcctgacttcacatgcagaagtacagaagagactgaagattggtttattgattcctttgaggagtggcgcaaagccaaaaaccttagcaactttattttgcttgggcactcctttggagggtatgtcgctgcaaaatatgctctcaagcatccagagcatgttcagcagttgattctggtaggaccagctggatttacatcagagactgaacatatgtccgagcggcttacccagtttagagcaacatggaa

SEQ ID NO: 126 - DNA, 593 bp, Artificial Sequence
  hpRNAi
actgctgatgctgtcaggcagtatctatggttgtttgaggagcataatgttcttgaattcctcgtacttgctggagatcatctatatcgaatggattatgaaaagttcattcaagcccacagagaaacagatgctgatattactgttgccgcactgccaatggatgaaaagcgagccactgcatttggtctcatgaagattgacgaagaaggacgcattattgaatttgcagagaaaccgaaaggagagcaattgaaagcaatgaaagtggatactaccattttaggtcttgatgatgagagagctaaagagatgccttttatcgcaagtatgggtatatatgtcattagcaaagatgtgatgttaaacttacttcgtgataagttccctggtgccaatgattttggcagtgaagttattcctggtgcaacttcgcttgggatgagagtgcaagcttatttatatgatggatactgggaagatattggtaccatcgaagctttctacaatgccaatttgggcattaccaaaaagccagtcccagattttagcttctatgaccgatcagctccaatctacacccaacctcgata

SEQ ID NO: 127 - protein, 5 aa, Artificial Sequence
  lipase motif
  misc_feature (2)..(2): Xaa can be any naturally occurring amino acid
  misc_feature (4)..(4): Xaa can be any naturally occurring amino acid
GXSXG

SEQ ID NO: 128 - protein, 6 aa, Artificial Sequence
  acyltransferase motif
  X (2)..(5): any amino acid
HXXXXD

SEQ ID NO: 129 - protein, 7 aa, Artificial Sequence
  probable lipid binding motif
  X (2)..(4): any amino acid
VXXXHGF

SEQ ID NO: 130 - DNA, 1224 bp, Arabidopsis thaliana
atggcggaagaaatctcaaagacgaaggtgggatcttcttctactgcttcggtggctgattcatctgctgctgcgtcggctgcaacgaatgcggccaaatcaagatggaaaattttgtggcctaattcgctccggtggattcctacgtccaccgattacatcatcgccgccgagaaacgtcttctctccatcctcaagacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtggggtggttcaagtaggcctgattttacatgtagaagcacagaagaaactgaggcatggtttatcgactcctttgaggaatggcgtaaagcccagaatctcagtaactttattctattaggacattcttttggaggctatgttgctgctaaatacgcgcttaagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttagaggattaggtccttggggtccaggtcttgtaaatcggtatacaactgcaagatttggtgcacattcggagggaactgggctaacagaagaggaagccaaattgctaaccgattatgtgtaccatactttggctgcaaaggctagtggagagttatgcttgaaatacatcttctcatttggagcatttgctaggaagcccctcttacaaagtgcatcagagtggaaagtgccaacaacgtttatctatggaatgaatgattggatgaactatcaaggtgcggtggaagcgaggaaatccatgaaggtcccttgcgaaatcattcgggttccacagggtggtcattttgtgttcatagacaacccaattggttttcattctgcagtgctttatgcttgccgcaagtttatatctcaagactcctctcatgatcaacaactcctagatggtctacgattggtttag

SEQ ID NO: 131 - DNA, 1700 bp, Brachypodium distachyon
tccgcgcccgaaacgatcccaacagaagctctaatctccaaagccgccgcgcgtgttgagggtggtgcggggaaaagcttggtgtcgtgagcccccgtgtcgcatgcgccgcgctgccgccgtgacgaggatggcagcgaccgaggagatgaggcaggcgtccgccgccgccgccgccacggtgaccgaggcctcggcgtcggcggccccgcccgcggggtccaggtgggcgcgggtgtggccggccgcgctgcgctggatccccacctccaccgagcgcatcatcgccgccgagaagcgcctcctctccgtactcaaaactgggtatgtccaagaacaagttaacattggctcggctccacccgggtcaaaagtaagatggtttagatcatcaagtgatgagccaaggttcatcaatacagtgacatttgatagcaaggagaatgctcccactcttgtcatggtccatggttatggtgcttcacagggtttcttctttagaaattttgatgcccttgcaagccgtttccgagtgattgccattgatcagcttggttggggtggatcaagtagacctgacttcacctgtaaaagtaccgaagaaactgaggcttggttcatagattctttagaggaatggcgtaaagcaaagaacctcagtaattttatattgctcggtcattctttcggaggatatgttgcagcaaaatatgccttgcagcatcctgaacacgtgcagcacttaattttggtcggttctgctgggttttcatcagaaacagatcatagctctgagtggttaaccaagtttcgagcaacatggaaaggcatgctagtgaaccaactatgggagtccaattttactcctcaaagaattgtaagaggattgggtccttggggcccagatttggttcgcagatataccactgctaggtttggctcatattcaacaggtgaattactaacagaacatgagtccggcttgctgacagattacatttaccatacattagctgccaaagctagtggagagctgtgcttgaaatatattttttccttgggggcatttgcaaggaaacctcttctgcagagtgcatctgactggaaagtgccgaccactttcatatatggccatgacgattggatgaaataccagggggcacagcaagcacgcaaggatatgaaagttccttgcgaaatcatcagagtcccacagggaggacattttgtgttcatagataacccttccgggttccattcggcagtcttctatgcgtgccggaaatttttatctggagatgcagaggagggtctctctcttcctgatggcctgatatctgcatgacagcatgaggcgcgatgtcataccaattagcggtatgaacacaaagcaaagctatacggagctaggaaatgttacaaatgtcacgactcaccagaaatgttacaaatgtcaccactcaccagtttcctttttgtatgtatgaattgtgtgaatatacacgtcattcatatttgccggcgtatcagtacttcaatagtgataaaacatgatcatatatatatgtatgatttctctagtcggttctcatcaagtcaagttattgtgattggtgaatgatatactttccaggtcaactttgtgtttgcatgtacaaactatcatggaacatatcagtatagtttatgatttgtcttcc

SEQ ID NO: 132 - DNA, 1484 bp, Glycine max
gtcatggatgcgcgtcactgctcgcgttcattataatggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcataggttaggtcttaattttgtgctattcctgtctatatgtattttaatatttttttttactaattaaatttcataattgaatgaaatcatatgtatattgtttcagtaaagtggaatttactgaaaatatttgtaatagcaacttcaacaaaaatcgatttgtaggagaaatttcttccctggaaattgttctattttaaatcttgttgctcataagatattatgacttcattcaactaataattcatgtcgtttaggaaaagtagttagttatattaaatttgtcaa

SEQ ID NO: 133 - DNA, 1662 bp, Zea mays
accatacgggcggggccgcaccgaccgaacctaaccgagagcacgagcatacccgtcccgactccgactgcagagcatcagccgaggagaaaagtcgggagaaacgcgcgtgacgtctgcccgcgtcgtatgcgccgcgctgccgtcgccgcgacgacgacgacgaccaggatggcagccgaggagatgagacgggcctccgcctcaacggccacggcggagatgccggcgtcgccggcgccggcgcaagcggggtcgaggtgggcgcgggtgtggccgcgcgcgctccggtggatccccacctccacggaccgcatcatcgccgccgagaagcgactcctcacgatagtcaaaactggatatgtccaggaacgagtcaacattggctctgctccacctgggtcaaaagtaagatggtttaggtcagcaagtgatgaaccaaggttcattaatactgtaacatttgatagcaaggagaatgcccccaccctggttatggtccatggctatggagcttcacaggggttcttctttcgaaactttgatgcccttgcaagccgttttagggtgattgccattgatcagcttggctggggtggttcaagcagacctgacttcacatgtaaaagtaccgaagaaactgaggcatggttcatagattctttcgaggagtggcgcaaggccaagaacctcagtaattttatattgcttggtcactcttttggaggatatgttgctgcaaaatatgcgctaaagcaccctgaacacgttcaacagttgattttggttggtcctgctggcttctcatcagaaacagagcatagctctgagtggttaaccaagtttcgagcaacatggaaaggcatgctaatgaatcgtctttgggagtccaattttactccccaaagggttattaggggattgggtccttggggtccaggtctagtacagagatataccagtgccaggtttggtacaagttctactggtgaattactaacagatgaagaatcggcattgatgacagattatatgtaccatacgttagctgccaaagctagtggagagctgtgcttgaaatatatattttccttcggggcatttgcaaggaaacctcttctgcagtgcgcgtccgattggaaagtgccgactactttcatatatgggcagcaagattggatgaactaccaaggcgctcagcaagcacggaaggacatgaaagttccttgtgaaataatcagggtgccgcagggtggacattttgtgttcatagacaacccttcagggttccactcggctgtcttctatgcgtgccgtaatcttctatcagtaaatggagaggagggattcacatttcctgatggcctaatatctgcgtgaagtggcatgttcaacaagcttgctcaacaacagtttacataaagcaaagatatacgattgtggaaatcattgcccatttccaccaatttgcttgtatacggattatgctgtgtatatattacataacaaatgtattagtatcatttaatgcacgatttgtgaaagggcctgagtttgtatttagcgaattttaggttggtttttttccctttttcttctttcagtgcgcttgctagtcaatcccatactataagccgtgatcatttaaaaaaaaaaaaaaaa

SEQ ID NO: 134 - DNA, 1763 bp, Sorghum bicolor
actgcagatgcgcggtcgtcggctccggctcgcggaggcgagaacggcgaaccagcccgtgtctctgttccctttcttccctttaaaaacacggcaaaaaaaaagctagccggttacgctaccgaaccgaacggctcggcacgcgggcacgggcgcggggtcgcaccggaaaagcacgagcagagcagacctgacgtctccagactgcaggagcatcatcagtcgaggaggaggaagtgtgggggggggaaagggaaacgtgcgcgtcgtatgcgcctcgctgccgtcgccaggacgaccaggatggcagccgaggagatgaggcgggcctcggcctccgcggcggtcgcggccacgacggaggcggcgccggcgccggcgcaagcggggtccaggtgggcgcgggtgtggccgagcgcgctccggtggatccccacctccacggatcgcatcatcgccgcggagaagcggctcctctcgatagtcaaaactgggtatgtccaggaacaagtcaacattggctcagctccacctgggtcaaaagtaagatggtttaggtcagcgagtgatgaaccaaggttcattaatactgtaacatttgatggcaaggagaacgcccccaccctggttatggtccatggctatggagcttcacaggggttcttctttcgaaactttgacgcccttgcaagtcgttttagggtgattgccattgatcagcttggctggggtggttcaagcagacctgacttcacatgtaaaagtaccgaagaaactgaggcatggttcatagattcttttgaggagtggcgcaaggccaagaacctcagtaattttatattgcttggtcactcctttggaggatatgttgcggcaaagtatgccctaaagcaccctgaacacattcagcacttagttttggttggtcctgctggcttctcgtcagaaacagaccatagctctgagtggttaaccaagtttcgagcaacatggaaaggcatgctagtgaatcatctttgggagtccaattttactccccaaagagttattagaggattgggcccttggggtccaggtctagtacaaagatataccagtgccaggtttggtacacgttcaactggtgatatactaacagatcaagaatcaacattgttgacagattatatttaccataccttagctgccaaagctagtggagagctgtgcttgaaatatatattttccttcggggcatttgcaaggaaacctcttctgcagtgcgcatccgattggaaagtgccgactactttcatatatggtcaggaagattggatgaactaccaaggggctcagcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctggtggcctaatatctgcatgaagtggcatgttcaacaatcttatcgtgcccaacaatagtttatatgaagcaaagatatacgatggtggaaatctttgctcatttccaccaatctggaaatatttgtgccctcttccaccaatttgtttgtatacggattatgccgtgtatatattctgtgttgactgtaagaaacataatgtattaacattatgtaatgtatgtacgattctttatttgattttcaacttgcaatacgcaagaaccac

SEQ ID NO: 135 - DNA, 1399 bp, Ricinus communis
cgcctttttaccagtcaatttccatttttatatataagtgcttttgcttaatttaagactaactacagcgacgaattcgcgtttatgaaattgcttcgcctacgactgctacgagtatctagctcctcaatatcatcaataatggcggaaggggctgctgccacatcagcatcagcatcagcgtcagcgtcagcgtcatgggcaaaaacaagatctctacggccatctgctctccgttggatcccaacttcaaccgatcacatcatcgccgccgaaaagcgtcttctctccctcgtcaagactccctatgttgtggaacaagtgaatatagggtctggcccaccggggtcgaaggtgaggtggtttcgttctaaaagcgacgaggcacggtttattaacacggttacttttgatagcaaagaggaggattctcctacactggttatggttcatggatatgctgcttctcaaggcttcttctttcgcaattttgatgctcttgcttctcgtttcaggctcattgctattgatcagctcggttggggtggatcaagtagacctgattttacgtgtaagagcactgaagaaactgaggcatggttcattgactcctttgaggcttggcgtaaagagaaaaacctcagtaacttcatcttacttggacattctttcggagggtatattgcagctaaatatgcactcaagcatcctgagcatgttcaacatctgattttagtgggatctgctggattttcatcagaatctgaagacaaatctgagcagcttactcggttcagagcaacatggaagggagcagttttgaatcatttatgggagtctaattttactcctcagaaggttattagaggtttaggtccttggggtccagatctcgtacgcaagtacacaactgctagatttggttcatattcaactggtgagatattaaaggaggaggagtccaaattgcttacagactatgtgtaccataccttagccgccaaagctagtggagagctatgcttgaaatatatattttcttttggagcatttgctcggatgccccttctacaaagcgcgtcacaatggaaagtgccaactactttcatatatgggatgcaagattggatgaattatcaaggggcccaaagagctcgcaaagatatgaatgtcccatgtgaaatcattagggttcctcagggcgggcacttcgttttcatagacaacccaactgggtttcattcagctgtgttatatgcctgccggagatttctctcacccgatcctgataatgaatctcttcctgaaggtctgatatctgcgtaggaagtgtggtttgtaattatttcttttttatttgttgtgtataatttatctgagaatttccaattctttcaat

SEQ ID NO: 136 - DNA, 1480 bp, Medicago truncatula
ggttggctcatagttccttttacctgttgaaaacaaaacatatggagtaacattttagtcagaaattcaaagctacgcacttgattaaactaattatcgaaaaatggcggaagaaattagacaaaaggacgacgtcgattcatcttcgaaatctaaaagcttctggtcttcactccgttggattcccacttctaccgatcatatcatcgccgctgagaaacgccttctttccattatcaagactgggtatgctcaagagcatgttaatataggttctggtcctcctggctctaaagttagatggttccgttcaaccagtaacgagccacgctttctcaacactgttacatttgatagtaaacccgattctcctacacttgttatggttcatggatacgctgcttctcagggtttcttctttcgcaattttgatgctctcgcctctcgtttcagaatcattgctgttgatcaacttggttggggaggatcaagcagacctgatttcacatgcaaaagtaccgaagaaactgaggcatggttcattgattctttcgaggaatggagaaaagccaaaaatcttaccaatttcatactgcttggacattcttttggtggttatgttgcttccaaatacgcgctcaagcaccctcagcacgtacaacacttaattttggtgggacctgccgggtttacagaagaaacagatccaaagactgagtttgttactaagtttcgagcaacatggaagggagcagttctgaaccatctatgggaatctaattttacacctcagaaaattgtcagaggtttaggtccttggggtcctaacatggtccgcaaatatacaagtgctaggtttggtacacattcaaccgggcaaaaactgattgacgaggaatcaagtctgctgactgattatgtttatcatacattggcggccaaagctagtggggagctgtgtttaaaatatatttttgcatttggagcatttgctaggatgccccttcttcaaagtgctcaagagtggaaggtgcccaccacattcatatatggttacgaagattggatgaattatgaaggtgcccaagaagctcgcaagcatatgaaggttccatgtgaaattatcagggtccctaaggccggccattttgtgttcattgacaacccaagtggcttccattcagctgtgttttatgcttgtcgaaggtttcttaccccaaattcggacaatgaatctcttcccgaagggctatcgtctgcttaggatttaattttgcatcaatccagtgtatattaatatggttattaatttttttttacttcataactgaatgaagccgtgtcttgtttctcagtgaagtggaatataatggaaatatatgtaattgtaataacaataatattgatttgttggggaactttgaggacaaaaacatattctggtaaaattttgttgcacatgcgacaaacatatgctgtg

SEQ ID NO: 137 - DNA, 1317 bp, Arabidopsis thaliana
gatctctctccctctctctctctctctctccgggaaaaatggataacttcttaccctttccctcttctaacgcaaactctgtccaagaactctctatggatcctaacaacaatcgctcgcacttcacaacagtccctacttatgatcatcatcaggctcagcctcatcacttcttgcctccgttttcatacccggtggagcagatggcggcggtgatgaatcctcagccggtttacttatcggagtgttatcctcagatcccggttacgcaaaccggaagtgaattcggttctctggttggtaatccttgtttgtggcaagagagaggtggttttcttgatccgcgtatgacgaagatggcaaggatcaacaggaaaaacgccatgatgagatcaagaaacaactctagccctaattctagtccaagtgagttggttgattcaaagagacagctgatgatgcttaacttgaaaaataacgtgcagatctccgacaagaaagatagctaccaacagtccacatttgataacaagaagcttagggttttgtgtgagaaggaattgaagaacagcgatgttgggtcactcgggaggatagttctaccaaagagagatgcagaagcaaatcttccgaagctatctgataaagaaggaatcgttgtacagatgagagatgttttctctatgcagtcttggtctttcaaatacaagttttggtccaataacaagagcagaatgtatgtcctcgagaacacaggagaatttgtgaagcaaaatggagctgagataggagactttttaacaatatacgaggacgaaagcaagaatctctacttcgccatgaatggaaattcgggaaaacaaaatgaaggaagagaaaatgagtcgagggaaaggaaccactacgaagaggcaatgcttgattacataccaagagacgaagaggaagcttccattgcaatgctcatcggaaatctaaacgatcactatcccatccctaacgatctcatggacctcaccactgaccttcagcaccatcaagccacgtcctcatcaatgccacctgaggatcacgcgtacgtgggttcatccgatgatcaggtgagctttaacgactttgagtggtggtgatatggtggtggaagttctcaagttcataaccccctttatgaaaatagaccttaagatatacaaaagagattaaaagaaaaaaaagttagtatatttcatcatatctctcattgaagatgagatttatatctataattgtttaatagtgtttttattacttttctatcaatatattaaagttttaatt

SEQ ID NO: 138 - DNA, 1439 bp, Medicago truncatula
tttcatccttacatattttgcatattgaaacacgtaggatggaataagattgataacaaaaattgcattgtttgcatattgaaaacatgggacaattgcatgggttcatgtgcttcattataagccacacattaggaaacacaggttgatattcaccactatttaacataagaatatctcatgtgtaagcattcatacaaatatcacaattgaattaaaaaccaaagaaatgtcttcctctaacttctcttgtatcctatccatctccttaacattcttcatcttgctactgaacaaggtgaattcagcagaaacaacttccttttccatcacaaaatttgtcccagatcaaaagaatctcatcttccaaggcgatgcgaaaactgcctcaacagggaagttagaactctccaaggcagtcaagaactctattggtagagctctttattccgcccctattcacatttgggatagcaaaaccggtagtgtggctaactttcaaactaccttcacctttacaataacggcgcctaatacttataatgttgcagacggtcttgcattcttcattgcaccaattgatactaagccgaaatcaattcatcatggaggataccttggagttttcgatagcaaaacttacaaaaaatcaattcaaactgttgcagttgaaattgacactttctataatgctcaatgggatccaaatcccggaaatataagtagcactggtcgacatattggaatcgatgtaaactctatcaaatcaataagcaccgtgccgtggagtttggaaaacaataaaaaggctaatgttgcgatagggtttaatggtgcaacaaatgtgttgagtgttgatgtggaatatcctttgattcgtcattataccctaagtcatgttgtgcctttgaaggatgttgttcctgagtgggtaaggattggtttctcttcttctactggagccgaatattcagcacatgatattttatcgtggtcttttgattcaaagttgaacctaggttttgagaacaatatcaatgccaatgtttcaagctctactcaagctgcatagttgaaaacttatccattatgtatgtgtgagtgtaaccaaccagtctaagaaaactataataagatacctgaaataatggttcattatcgtgtagtagaaatatggtcacaccatatcttcttttttttttaataaattatggaataatgctatttctcgcgagagttatgtttcggaaagattcatgaatagatgttaatcaattagatctatatatatatatatatatatatatatatatatatatatagcattttcttaaattatgcatatgtaatatcgtgtaatgctattgtttatatcaatgaatggtgttttgtagtcacataattcgtaatttctctccatgagaacagcgaaccaatta

SEQ ID NO: 139 - DNA, 1393 bp, Brassica napus
gagatgggtatccctataaggtgcagcatcgaaccatctgcaacattttgactcgttttcttttgtgtttttataacatctgtctcttcttcactcgatctccctctcttttctttttcaatctccccaacgaacctcccttcataactctctttctctccccgggaaatatggataacttcttgcccttttcctcttctaacgcaaactctgtccaagaactctccatggatcttaacaagaatcgctcgcacttctccatggcgcagcctcagcacttgttgccgccttactcgtacgttgcatgtccggcacttgatcagacggggaccatgaatcatcagcctcttcactcatcggatgcttttcctcagatcccggttgtacaaaccggaggtgaattcggctatttggtttgtaagcccggtgtgaggcaggaacgaggtggatttcttgatccacactccactaagatggctaggatcaacaggaagaaggcgatgctaagatcaagaaacaactctaaccctaattctagttcgaatgagttggttgattcaaggagacaagtggctcttaccatgaaaaataatgccgagattgctgctagaaaagatttttatcgattctcctcattcgataacaagaaacttagggttttgttggtgaagcacttgaagaacagcgatgttgggtcacttggaaggattgttctaccaaagagagaagcagaaggaaatcttccggagctatctgataaagaaggaatggtattagagatgagagatgttgactctgtgcagtcttggtctttcaaatacaagtactggtccaataacaagagcagaatgtatgtcctcgaaaacacaggagaatttgtgaagaaaaatggagtattgatgggagactatctaacaatctacgaggacgaaagcaagaatctctacttctccatcagaaagcacccacacaaacaaaatgatggaagagaggatgagtcgatggaagttatcgagatgaacttctatgaagatataatgtttgattacataccaaatgatgaagacgattccattgcaatgctcctcggaaatctaaacgagcactatccctacccaaatgatcttatggatctcactgtcaatcttgatcagcatcagcaagccacctcctcgtcgccacctgctgatcacatgagctcgaacgatttcttatggtgatgtgatggacgttgatatggattccctttgagatgatatacaagggatgaaaagaaaagagtatcatattcatatccatatttgtttgataaaatgtgtttgttcccaatctattatttatgaaaaacttatttgtgtttaactccagattaattaaatatttttcatttgac

SEQ ID NO: 140 - DNA, 1755 bp, Arabidopsis thaliana
atgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggcatcggtggacaggtagatacgaggcacatttatgggacaatagttgcaaaagagaaggccagactcgcaaaggaagacaagtttatctgggaggttatgacaaagaagaaaaagcagctagggcttacgatttagccgcactaaagtattggggaaccaccactactactaacttccccttgagtgaatatgagaaagaggtagaagagatgaagcacatgacgaggcaagagtatgttgcctctctgcgcaggaaaagtagtggtttctctcgtggtgcatcgatttatcgaggagtaacaaggcatcaccaacatggaaggtggcaagctaggatcggaagagtcgccggtaacaaagacctctacttgggaactttcggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttag

SEQ ID NO: 141 - DNA, 2061 bp, Medicago truncatula
atgaacttgttaggtttctctctatctccacaagaacaacatccatcaacacaagatcaaacggtggcttcccgttttgggttcaaccctaatgaaatctcaggctctgatgttcaaggagatcactgctatgatctctcttctcacacaactcctcatcattcactcaacctttctcatcctttttccatttatgaagctttccacacaaataacaacattcacaccactcaagattggaaggagaactacaacaaccaaaacctactattgggaacatcatgcatgaaccaaaatgtgaacaacaacaaccaacaagcacaaccaaagctagaaaacttcctcggtggacactctttcaccgaccatcaagaatacggtggtagcaactcatactcttcattacacctcccacctcatcagccggaagcatcctgtggcggtggtgatggtagtacaagtaacaataactcaataggtttatctatgataaaaacatggctcagaaaccaaccaccaccaccagaaaacaacaacaataacaacaatgaaagtggtgcacgtgtgcagacactatcactttctatgagtactggctcacagtcaagttcatctgtgcctcttctcaatgcaaatgtgatgagtggtgagatttcctcatcggaaaacaaacaaccacccacaactgcagttgtacttgatagcaaccaaacaagtgtcgttgaaagtgctgtgcctagaaaatccgttgatacatttggacaaagaacttccatttaccgtggtgtaacaaggcatagatggacagggagatatgaagctcacctttgggataatagttgtagaagagaggggcagactcgcaaaggaaggcaagtttacttgggaggttatgacaaagaagaaaaagcagctagagcctatgatttggcagcactaaaatattggggaacaactactacaacaaattttccaattagccattatgaaaaagaagtggaagaaatgaagcatatgacaaggcaagagtacgttgcgtcattgagaaggaaaagtagtggtttttcacgaggtgcatccatttaccgaggagtaacaagacatcatcaacatggtagatggcaagctaggattggaagagttgcaggcaacaaagatctctacctaggaactttcagcactcaagaagaggcagcagaggcatatgatgtggcagcaataaaattcagaggactgagtgcagttacaaactttgacatgagcagatatgatgtcaaaaccatacttgagagcagcacattaccaattggtggtgctgcaaagcgtttaaaagacatggagcaagttgaattgaatcatgtgaatgttgatattagccatagaactgaacaagatcatagcatcatcaacaacacttcccatttaacagaacaagccatctatgcagcaacaaatgcatctaattggcatgcactttcattccaacatcaacaaccacatcatcattacaatgccaacaacatgcagttacagaattatccttatggaactcaaactcaaaagctttggtgcaaacaagaacaagattctgatgatcatagtacttatactactgctactgatattcatcaactacagttagggaataataataacaatactcacaatttctttggtttacaaaatatcatgagtatggattctgcttccatggataatagttctggatctaattctgttgtttatggtggtggagatcatggtggttatggaggaaatggtggatatatgattccaatggctattgcaaatgatggtaaccaaaatccaagaagcaacaacaattttggtgagagtgagattaaaggatttggttatgaaaatgtttttgggactactactgatccttatcatgcacaggcagcaaggaacttgtactatcagccacaacaattatctgttgatcaaggatcaaattgggttccaactgctattccaacacttgctccaaggactaccaatgtctctctatgtcctcctttcactttgttgcatgaatag

SEQ ID NO: 142 - protein, 363 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVSFNDFEWW

SEQ ID NO: 143 - protein, 280 aa, Medicago truncatula
MSSSNFSCILSISLTFFILLLNKVNSAETTSFSITKFVPDQKNLIFQGDAKTASTGKLELSKAVKNSIGRALYSAPIHIWDSKTGSVANFQTTFTFTITAPNTYNVADGLAFFIAPIDTKPKSIHHGGYLGVFDSKTYKKSIQTVAVEIDTFYNAQWDPNPGNISSTGRHIGIDVNSIKSISTVPWSLENNKKANVAIGFNGATNVLSVDVEYPLIRHYTLSHVVPLKDVVPEWVRIGFSSSTGAEYSAHDILSWSFDSKLNLGFENNINANVSSSTQAA

SEQ ID NO: 144 - protein, 349 aa, Brassica napus
MDNFLPFSSSNANSVQELSMDLNKNRSHFSMAQPQHLLPPYSYVACPALDQTGTMNHQPLHSSDAFPQIPVVQTGGEFGYLVCKPGVRQERGGFLDPHSTKMARINRKKAMLRSRNNSNPNSSSNELVDSRRQVALTMKNNAEIAARKDFYRFSSFDNKKLRVLLVKHLKNSDVGSLGRIVLPKREAEGNLPELSDKEGMVLEMRDVDSVQSWSFKYKYWSNNKSRMYVLENTGEFVKKNGVLMGDYLTIYEDESKNLYFSIRKHPHKQNDGREDESMEVIEMNFYEDIMFDYIPNDEDDSIAMLLGNLNEHYPYPNDLMDLTVNLDQHQQATSSSPPADHMSSNDFLW

SEQ ID NO: 145 - protein, 584 aa, Arabidopsis thaliana
MNSMNNWLGFSLSPHDQNHHRTDVDSSTTRTAVDVAGGYCFDLAAPSDESSAVQTSFLSPFGVTLEAFTRDNNSHSRDWDINGGACNTLTNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQVYLGGYDKEEKAARAYDLAALKYWGPTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 146 - protein, 686 aa, Medicago truncatula
MNLLGFSLSPQEQHPSTQDQTVASRFGFNPNEISGSDVQGDHCYDLSSHTTPHHSLNLSHPFSIYEAFHTNNNIHTTQDWKENYNNQNLLLGTSCMNQNVNNNNQQAQPKLENFLGGHSFTDHQEYGGSNSYSSLHLPPHQPEASCGGGDGSTSNNNSIGLSMIKTWLRNQPPPPENNNNNNNESGARVQTLSLSMSTGSQSSSSVPLLNANVMSGEISSSENKQPPTTAVVLDSNQTSVVESAVPRKSVDTFGQRTSIYRGVTRHRWTGRYEAHLWDNSCRREGQTRKGRQVYLGGYDKEEKAARAYDLAALKYWGTTTTTNFPISHYEKEVEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKTILESSTLPIGGAAKRLKDMEQVELNHVNVDISHRTEQDHSIINNTSHLTEQAIYAATNASNWHALSFQHQQPHHHYNANNMQLQNYPYGTQTQKLWCKQEQDSDDHSTYTTATDIHQLQLGNNNNNTHNFFGLQNIMSMDSASMDNSSGSNSVVYGGGDHGGYGGNGGYMIPMAIANDGNQNPRSNNNFGESEIKGFGYENVFGTTTDPYHAQAARNLYYQPQQLSVDQGSNWVPTAIPTLAPRTTNVSLCPPFTLLHE

SEQ ID NO: 147 - DNA, 336 bp, Artificial Sequence
  inducible promoter
tcgatagttgtgatagttcccacttgtccgtccgcatcggcatccgcagctcgggatagttccgacctaggattggatgcatgcggaaccgcacgagggcggggcggaaattgacacaccactcctctccacgcaccgttcaagaggtacgcgtatagagccgtatagagcagagacggagcactttctggtactgtccgcacgggatgtccgcacggagagccacaaacgagcggggccccgtacgtgctctcctaccccaggatcgcatccccgcatagctgaacatctatataaagacccccaaggttctcagtctcaccaacatcatcaacc

SEQ ID NO: 148 - DNA, 2466 bp, Artificial Sequence
  inducer
atggccgacactagaagaaggcagaaccactcttgtgacccatgccgtaagggcaagagaagatgtgatgctccagagaaccgtaacgaggctaatgagaacggatgggtgtcatgctctaactgcaagaggtggaacaaggactgcaccttcaactggcttagctcccaaaggtctaaggctaagggtgctgctccaagagctaggactaagaaggctaggactgctactactacctccgagccttctacttccgctgctactattccaactcccgagtccgataatcacgatgctccaccagtgatcaactcccacgatgctttgccatcttggactcagggacttctttctcaccctggcgatctcttcgacttctcccattctgctattccagctaacgctgaggatgctgctaacgtgcaatctgatgctccattcccatgggatcttgctatcccaggcgatttctctatgggacagcaacttgagaagcccctctccccattgtctttccaggctgttcttcttccaccacactccccaaacactgatgatctcattcgtgagcttgaggaacagactaccgatccagattccgtgactgacactaactccgttcagcaagttgctcaggatggctctctttggtctgataggcagtctccactcctcccagaaaacagtttgtgcatggcttccgactctaccgctagaaggtatgctaggtccaccatgaccaagaacctcatgaggatctaccacgactccatggaaaacgccctttcttgctggcttactgagcacaactgcccatactccgaccagatttcttacctcccaccaaagcaaagggctgagtggggaccaaattggtctaacaggatgtgcattagggtgtgcaggctcgatagggtgtcaacttctcttagaggaagggctctctccgctgaagaagataaggctgctgctagggcacttcaccttgctattgtggctttcgcttctcagtggactcaacatgctcaaaggggagctggacttaacgtcccagctgatattgctgctgacgagcgttctattaggcgtaacgcttggaatgaggctaggcatgcacttcagcacactactggaatcccatccttcagggtgatcttcgccaacatcatcttcagcctcactcagtccgtgctcgatgatgatgagcaacatggaatgggagctaggctcgataagcttctcgagaatgatggtgctccagtgttcctcgagactgctaataggcagctctacaccttcaggcacaagttcgctaggatgcagagaaggggtaaggctttcaataggcttcctggtggatccgtggcttctactttcgctggaattttcgagactcccaccccctcatctgagtctccacaacttgatccagtggtggcttctgaggaacacaggtctactctgtctctcatgttctggctcgggatcatgttcgacactctgtctgctgctatgtaccagaggccacttgttgtgtccgatgaggactcccagatctcttctgcttctccaccaagaagaggtgccgagactcctattaaccttgattgctgggagccaccaaggcaggtcccatctaatcaagagaagtctgatgtgtggggcgacctgttccttaggacttctgattctttgcccgaccacgagtcccacactcaaatttctcaaccagctgctaggtggccatgcacttatgaacaagctgctgctgctctctcctctgctactcctgttaaggtgttgctttacaggcgtgtgactcagctccagactttgttgtataggggagcttctccagctaggcttgaggctgctattcagaggactctctacgtgtacaaccactggactgctaagtaccagccattcatgcaggattgcgttgccaaccatgagcttctcccatccaggatccagtcttggtacgtgatccttgatggacactggcaccttgctgctatgcttttggctgatgtgctcgagtccatcgacagggattcctactccgatatcaaccacatcgacctcgtgactaagctcaggcttgataacgctcttgctgtgtctgctctcgctaggtcatctcttagaggccaagaactcgatccaggcaaggcttctccaatgtacaggcacttccacgactcccttactgaggttgcattccttgttgagccatggactgtggtgctcatccactcatttgctaaggctgcttacatcctcctcgattgccttgatcttgatggtcagggaaacgctctcgctggataccttcaacttaggcagaactgcaactactgcatcagggctctccagttccttggccgtaagtctgatatggctgctctcgtggctaaggatcttgagaggggactcaacggaaaggtcgacagcttcctctaa

SEQ ID NO: 149 - protein, 208 aa, Arabidopsis thaliana
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 150 - protein, 236 aa, Arabidopsis lyrata
MERGAPFSHYQLPKSISELNLDQHSNPNPMTSSVVVADASDNNKGIVAQQQPPCMAREQDQYMPIANVIRIMRKILPSHAKISDDAKETIQECVSEYISFVTGEANERCQREQRKTITAEDILWAMSKLGFDNYVDPLTVFINRYREIETDRGSALREPPSLRQAYGGNGIGFHGPSHGLPPPGPYGYGMLDQSMVMGGGRYYQNGSSGQDESSAGGGSSSSINGMPAFDSYGQYK

SEQ ID NO: 151 - protein, 230 aa, Brassica napus
MERGAPLSHYQLPKSNSGLNLDQHNNSIPTMTGSISACDDKNKTILPQQQPSMPREQDQYMPIANVIRIMRKILPPHAKISDDAKETIQECVSEYISFVTGEANERCQREQRKTITAEDILWAMSKLGFDDYVGPLNVFINRYREFETDRGCSLRGESSFKPVYGGSGMGFHGPPPPGSYGYGMLDQSMVMGGGRYYHNGSGQDGSVSGGGGSSSSMNGMPVYDQYGQYK

SEQ ID NO: 152 - protein, 252 aa, Ricinus communis
MERGGRVHRYRRHAKQPTPTTSATASTSPGMSSVQTTICSNINLPSTLSLSNSTAAPQAPQQQQLQPSQCLVREQDQYMPIANVIRIMRRILPPHAKISDDAKETIQECVSEYISFITGEANDRCQREQRKTITAEDVLWAMGKLGFDDYVEPLTLFLNRYREMENERSTIRDPILKRSSVGVVDYGNLGMNPFMPTFPMIPPPQGYFDSNMLGGYYRDAPDGASGAASGSNLAASSAPNSLLHFDPFAQFK

SEQ ID NO: 153 - protein, 198 aa, Glycine max
MNMNMRQQQVASSDQNCSNHSAAGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLATAFVPPPFHHHNGYFGAAMPMGTYVRETPPNAASSHHHHGISNAHEPNARSI

SEQ ID NO: 154 - protein, 240 aa, Medicago truncatula
METGGGFHGYRKLPTNTNSSAVAGTLKLSSVSEMNTRQQVGEQNNNGTEQDNECIVREQDRFMPIANVIRIMRKILPPHAKISDDAKETIQECVSEYISFITGEANERCQREQRKTITAEDVLWAMSKLGFDDYIEPLTMYLHRYRELEGDRTSMRVEPLGKRGMEYGNLGGFVPQFHIGHPNGGYYGNAAPTYMMRDGNNNNNNNNNAPNAANAAGGSSHSQALANAEANGHHHHHQYK

SEQ ID NO: 155 - protein, 278 aa, Zea mays
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHSMSPAAMLKSRGPVSGAAMLPHHHHHHDMQMHAAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 156 - protein, 225 aa, Arachis hypogaea
METGGGFHGYRNLPTTTSGLKLSVSEMNMRAVENNTGSSNNNHTDDNECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVDYGTLGVAAASTFVPPFHIGHHHHHPHPSSYYGTPMGNYIRDAPNAGSSLQPPSLAHAEPNTQYK

SEQ ID NO: 157 - protein, 234 aa, Arabidopsis thaliana
MERGGFHGYRKLSVNNTTPSPPGLAANFLMAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 158 - protein, 231 aa, Brassica napus
MERGGFHGYRKFSLNTTNPSEPARFLMAEGSMQLAEPNQTNKTANGGEEECVVREQDRFMPIANVIRIMRRILPAHAKISDDSKETIQECVSEYISFITGEANERCQREQRKTITAEDVLWAMSKLGFDDYIEPLTLYLHRYRELEGDRGVGYNAGSVGMTSGMVVKRPNGTMGEYGAYGVVPGMHMAPYHYRHQNGYAYSGNEPDSKMGGPSSAANGSRVELFPTQQHKY

SEQ ID NO: 159 - protein, 216 aa, Phaseolus coccineus
MESGGFHGYRKLPNTTSPGLKLSVSDMNNVNTSRQVAGDNNHTADESNECTVREQDRFMPIANVIRIMRKILPPHAKISGDAKETIQECVSEYISFITGEANERCQREQRKTITAEDVLWAMSKLGFDDYMEPLTMYLHRYRELEGDRTSMRGESLGKRTIEYAPMGVGVATAFVPPQFHPNGYYGPAMGAYVAPPNAASSHHHGMPNTEPNARSM

SEQ ID NO: 160 - protein, 312 aa, Arabidopsis thaliana
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 161 - protein, 321 aa, Brassica napus
MMADENVETKASTLIASVGHQGHGFGSGSGGHHGLSASVPLLGVNSKKRRMPRQRRSSSSFNLLSLPPPMPLSPHVPTPLSARKIDPRKLRFLFQKELKNSDVSSLRRMILPKKAAEAHLPALECKEGIPIRMEDLDGLHVWTFKYRYWPNNNSRMYVLENTGDFVNAHGLQLGDFIMVYLDLDSNNYVIQARKASEEEEEEEDVTIIEEDDVYTNLTKIENTVVNDLLIQDFNHHNDNSSNNNSNNNINNNKCSYYYPVIDDITTNTASFVYDTTTLTSNDSPLDFLGGHTTTTTNTYYSKFGSFEGLGSVENISLDDFY

SEQ ID NO: 162 - protein, 314 aa, Medicago truncatula
MMMDEGEGKKKVVVQKTEACGFMAGVEDELGFVNVKGDNNNGSGQRIHHDHGFVAAAFGTVHRKKRMARQRRSSSSTITIHLKNLPSSTTTTTTTTTSHVPISPIPPLFHSLPPAREIDHRRLRFLFQKELKNSDVSSLRRMVLPKKAAEAFLPVLESKEGILLSMDDLDGLHVWSFKYRFWPNNNSRMYVLENTGDFVSTHGLRFGDSIMVYQDNQNHNYVIQAKKACDQDEYMEEANDTINHIFVDDYEVNKSCFDVAYPAMNDTSMSFIYDTTISNDSPLDFLGGSMTNYSRIGSVETFGSVENLSLDDFY

SEQ ID NO: 163 - DNA, 3275 bp, Arabidopsis thaliana
ggttggctatatggtccaaattttgatttgcaatatgagattgcacagagagaacaatctttcattatgattaattattgtacaagtaacaaacaccaatctccgatatactttggctctttagcacattgttatgctagaagttagcggaaatctatatgttgttaaacgcagcgtttaaattgaacagtgtaatttaccttgaaattttaagactacatgctgtttagaatttcagatgaaaacatcttgatgttttagaaatccacgtgggaatagcgtaaaatcttatccaacgaacttattttggttttgttgtatttgtgcaagtcgtcacgctaatcgaaaaaagaaaagaaaaaaagaagccgtcatgatcggccatttctcggccgagtctgagtctgactctgcgtccgtgtcaccattatcagatcgagcctgtcttatctcgttgcgattccctatgcaaaaatcttcttcttttttttattcccccatttatctctgatctcttctctcttctcaagtaaacctctctgcttcacgtctcttcttttcttgtcgattttccccagataatcagttgaaaacacacccaaattcatcttcgaatcaataatggatataagtaatgaggctagtgtcgatcccttttcgattggaccatcatctatcatgggtcgaaccattgctttcagagtcttgttctgtagatcaatgtcacagcttaggcgtgatctctttcggttcttgttgcattggtttcttagatttaagctgaccgtttcaccgtttgtgtcgtggtttcatcctcggaaccctcaagggattttagcggtggttacaatcattgcctttgtgttgaaacgatacacgaatgtgaaaataaaggcggaaatggcttaccggaggaagttttggaggaatatgatgcggacggctttgacttatgaggaatgggctcatgctgctaagatgttagagaaggaaacaccaaagatgaatgaatctgatctttatgatgaagagttggttaagaacaagcttcaggagcttcgtcatcgtcgccaagaaggctcacttagagacattatgttttgtatgagagctgatttggtgaggaatctcggtaatatgtgtaattcggagcttcataaaggtagacttcaggttcctagacatatcaaagagtacattgatgaggtgtctactcagttgagaatggtttgtaactctgattcagaggagctttctttagaagagaagctttcttttatgcatgaaacacggcatgcctttggtagaacggctttgcttttgagtggtggggcttctcttggtgcgtttcatgttggtgtggttaggactttggttgagcataagcttttacctcgaataattgctggttctagtgttggatccatcatttgtgctgttgtggcctcaaggtcttggccagaactacagagtttctttgagaattctttgcattctttacagttctttgatcagctcggaggcgtgttctcaatagtgaaacgggtaatgacacaaggggctctacacgatatcagacagttgcaatgtatgcttagaaacctcacaagcaatctcacattccaagaagcttatgacatgacaggaaggattctcgggatcaccgtttgctccccaagaaagcatgaacctcctcggtgtcttaactatttgacttcgcctcatgtggttatatggagcgcagtgactgcttcttgtgcttttcctggtctctttgaagctcaagagctaatggctaaagatcgaagtggagagatcgtaccgtatcatccacctttcaatttggatccagaagtaggcactaaatcatcatctggacgccggtggagagatggtagtttggaggttgatttaccaatgatgcagcttaaagaactgttcaatgtcaatcattttattgtgagccaagccaatcctcacattgctccattactgcgtctaaaggatttagttcgagcttatggtggtagattcgcagctaagctcgcgcatctagtggagatggaggtcaaacatagatgcaaccaggtattagagctcggttttcctctcggtggactcgcaaagctttttgctcaggagtgggaaggtgatgttacagttgtaatgcctgctactcttgctcagtactcgaagattatacaaaatccgactcatgtcgagcttcagaaagcggctaaccaaggaagaagatgcacttgggagaagctctcagccataaaatcaaactgcgggatcgagcttgcgcttgatgattctgtagctattcttaaccatatgcggaggctcaagaaaagtgcggagagagccgccactgccacgtcttcgtctcatcacggattggcttcaaccaccagattcaatgcttcaagaagaatcccatcttggaacgtccttgccagagagaactcaacaggctcactggatgatctagtcactgacaataacctccacgcttcttcgggcaggaatttaagcgacagtgaaacagagagcgtggagttgagttcttggacaagaactggtggacctttaatgagaacagcttctgctaataagttcattgattttgttcagagtcttgatatcgacattgcattggtcagaggatttagtagcagtcccaattctccagcagttcctcctggtggctcgtttactccaagcccgagatccatagcggctcattcggatatcgaatcaaacagcaatagcaacaatcttggaacaagcacttcaagcataacagttactgaaggtgatcttctacagcctgagagaacgagtaacggatttgtgttaaacgtcgttaaaagagagaacttgggaatgccatcgattgggaaccaaaatacagagttaccagagagtgtacagctcgatataccggagaaggagatggattgtagctctgtatcagaacacgaagaagatgataacgacaatgaagaagaacataacggctcgagtctggttactgtttcttcagaagattccggtttacaagaaccggtgtctggtagtgttatagatgcttagagtgtgattgattcaagtgagtatagattcttaattaaatttgcagagtttccaaagggtttagtgcaccacttgtgtatgtttgtattgcttattgtttgaaattcatttgtgaaatcgaaatatatctgtaaattcagaaaatattctctcatccattacaaaatatttgagtc

SEQ ID NO: 164 - DNA, 2795 bp, Brassica napus
tcccacgctcaggttctaattgcaaaaaaggatcatactttccttattaaaatcaatttcctgtgcttgatttctatcttaggaagctcgtagtagtttctctgatagtgaatttgatgaaacaaagaaaaaaatgctgacttggtctcagattctaattaaacacacacacacacataacctccaatggatataagcaacgaggccaatgtcgatcccttctcaatcggaccaacctccatcctcggccgaaccatcgccttcagagtcctcttctgcaaatcaatgctccagctccgccgcgacctcttccgcttcctcctccactggttcctcacactcaagctcgccgtctccccctttgtctcctggttccacccccggaacccccaggggatcctcgccgtcgtcacgatcatcgccttcgtcctgaaacgctacaccaacgtgaaggccaaggccgagatggcctaccgtagaaagttctggaggaacatgatgcgcgcggcgttgacttacgaggaatgggctcacgccgctaagatgttggataaagagactccgaagatgaacgagtccgatctttacgatgaagagttggttaagaacaagctaatggagcttcgtcatcgacgtcatgagggctctcttagagacattattttctgtatgagagctgatcttgtgagaaatctcggtaatatgtgtaaccctgagcttcacaagggaaggcttcacgtgccgagactcatcaaagagtatatcgatgaggtctctacacagcttaggatggtttgcgacatggacactgaagagctttctctggaggagaaactttcttttatgcatgagaccagacacgcgtatggaagaacagctctacttctcagtggaggagcttctcttggggctttccatcttggtgtggtcaagacgcttgtggaacataagctattgccaagaattatagctggttcaagcgtggggtctgtaatgtgtgcggttgtggggacaaggtcatggcccgagttgcagagcttctttgaagggtcctggcatgctctgcagttctttgatcagatgggaggaattttcactactgtgaagcgggttatgactcaaggcgcagtccatgagatccggcatctgcaatggaagttgaggaatctcaccaacaatctcacagtccggaatttccgggtcgacgacttcgaggatactcgggataacggtttgctcaccgacgaagcactagccgcctcggtgcttaactatctcacttctcctcacgtggtgatatggagcgcggtgactgcttcttgcgctttccctggtttgtttgaagctcaggagctgatggctaaagataggagtggggagatagtgccgtatcatccgccttttaatttggaaccggaggaaggtggggataagtcgtctacgaggaggtggagagatgggagtttggaggttgatttgccgatgatgcagcttaaggagctgtttaatgttaatcattttattgtgagccaggctaatcctcacattgctccgttgctgcgtttgaaggatatagttagagcttatggaggtcgatttgcagcaaagctcgcgcaactcgcggagatggaagtgaagcatagatgtaatcaagtactagaactcgggcttcctctaagagaagtagcttcactatttgctcaagaatgggaaggcgatgtcacaattgtcatgccagctactttttctcagtacttgaagatcatacaagtcgacgatttcgtcgagcttcaaaaagccgctaaccaaggaaggagatgcacttgggagaagctatcagccataaaagcaaactgtgggatcgagcttgcgcttgatgagtgtgtaactaatcttaaccatatgcgtaggctcaacagaagcgctgagagagccgctgctgctgctggcacgtcctcctcgtctcatcacggattagcttcaacgacaagattcaatgcttctagaagaatcccgtcttggaacgtcatcgctagagagaactcaactggctcactggacgacctcgtcactgacagtaacaataataatctccacgcggggaggaacctaagcgacagcgaaacggagagcgtggagatgagttcttggacgaggactggtggaccgttgatgagaacagcttctgctaataggttcactgactttgtccatggtcttgacgtggacattgcgttgacaagagggtttactagcagccctaactctccagcggttcctggcccggttagtccgagttttagtccaagatcgagatccttggcggctcaatccgagagcgaatctgacaagagggaaagtagcaacagttctagtatatcagctactgaaggtgatcttctgcagcctgagagaacgagtaacggttttgttttgaacgttgttagaagagagaacttggggatgcctgtggagaaccagagcggtgagctgccggagagtgtacagatagatatacctgagagggagatggataatagctctgtctcaggacatgaagatgataatgatgataatgatgatgaagaagaagaacataagggctcggttccggttaaagattccggtttacaagattcttgtagtgtaatagatgcttagactgatttgatccgagtgaagagattcttgttcagcaaagatcttggagtgttttagtgctttgtaaatagtacaactataggccgcaagtaaggtgcatgttgtgtatgtttgcagtgattatgttgaaaatt

SEQ ID NO: 165 - DNA, 2670 bp, Brachypodium distachyon
atggaagaatccggagaagcgagtattggggccttcaggatcgggccgtcgacgcttctcggccgcggcgtcgcgcttcgcgtgctcctgttcagctcgctctggcgtctccgggcgcgggcgcgcgccgctgtgtcgcgcgtgcgcagggccacgctgccaatggccgcgtcctggcttcacctcaggaacacccatggcgtcctcctgattctcgtgctcttcgggttgctcctcaggaagctctccggtgcgcggtcgcggctggcgctggcgcgccggcgtaggctgtgcaagagcgcgatgcgctacgcggcgacgtatgagcagtgggtgcgtgccgccaaggtgctcgacagaatgtctgagcaggtgaacgagtctgatttttacgacgaggagctgatcaagagtaggcttgaggagctccggaggcggagggaggaagggtcgctccgggatgtggtgttctgtatgcgcggcgatctcgtgaggaacttggggaacatgtgtaatcctgagcttcataagggcaggctcgaggtgcccaggctgataaaagatttcattgatgaggtttcaactcagctgaaaatggtgtgtgaatctgacaccgatgcgttatttttggaagagaagcttgcctttgttcaggaaaccaggcatgcctatgggaggacagcactactcttaagtgggggcgcttcactgggctctttccatgtaggtgtagtgaaaacattagttgagcataagcttctgcctcggataatagcagggtctagcgttggttccattatatgttcaattgttgctactcgaacatggcctgagattgagagcttcttcatagactcattacaaatcttacagttcttcggtaggataggtggaatttttgctgtgaccaaacgggttatgacttatggtgcacttcatgacattagccagatgcaaaggcttttgagggatctcacaagtaacttaacatttcaagaggcttacgatataactggccgtgttcttggggtcactgtttgctctcccagaaaaaacgagccacctcgctgcctcaactacctgacatcaccacatgttgttatctggagtgctgtaactgcttcgtgtgcattccctggcctctttgaagctcaggaattgatggcaaaggataggtttggccacatagttcccttccatgcgcccttttccacagatccagaacaaggtcctggagcatcaaagcggcgatggagggacggaagtttggagatggatttaccgatgatgcaactaaaggagttattcaatgtgaatcatttcatcgtcagccaagctaatcctcacatctctccactcctccgaatgaaggagattgtcagatcctatggaggtcgctttgcgggaaagctcgctcgtcttgctgagatggaggtgaagtatcgatgtaaccaagttctagaagttggcctcccactgggaggacttgcaaagttgtttgctcaggactgggagggtgatgtcactatggttatgccagcaacagtagctcagtacttgaagattatacaagatccaacatatgcagaactccaaatggctgccaatcagggtcaaagatgcacgtgggagaagctctcagcgatcagagcaaactgtgcaattgaacttgcattggatgaatccattgcggttctcaaccacaaacgaaggttaagaagaagcacaagggcagcagcttcttcccaggaatataccagcaatgttcgactcagaacaccaaggagggtaccctcatggagctgcatcagtcgagagaattcgtcaggatctctctcagaagatcactttgcggtcgctatttcatccagtcaccaaggtactatacgagttgatggcgcaccaaacatgcctcatcatgttcgtcacagttcacacgatggaagtgagagcgaatcagaaaccattgacttaaattcatggaccaggagtggtgggcctctaatgaggacttcatcagctgatcagttcatcagttttatccagaatctcgagattgaatctgagttcgatagggttcgtactacagaggatgacaatacaggtattttatcaggatctacattttcaaaagatccatacccaaacattagttctagagtcactacaccagatagatgcacagaagtttctgaaacagagtcgtgcaacgccggcaacacaagcatcactgtttctgaaggagatttgctacaacctgagaggactaccaccggaattctactcaattttgtcagaagagaagatctgcttggtcagcataacagtgatgctgacatgaccgaaagctccttagccgaagcatatgtggacacatcacatttggaatcttgtgatgccatctcagcctctgacagttctgaaggtaacaaagacgcagctgactcagagaatctcttggtttctcatgcagatttagtaacttcgcatcaatcttcagttgatgataacaaaggtggctagattttgaaagaattcttttagtggcttgctaagtcgatgctgtacaggaaaaactgtagtgtctccgtttcgtgagcactactgctggtagcatagtgaatattgtactttgtaccagatactaaataaatttgattgcttgccatt

SEQ ID NO: 166 - DNA, 3884 bp, Artificial Sequence
  Populus trichocarpa
gttttctttcccttatccgcctttgattgcaaaagtcaatgtcagagccatcaccccctccttgctcaatctttacgtaaccgtatgtatatccttatcttcttctaacatttcccaagactccgatcctgtatttattgtattcacttcacccttcttctctctttccttcccgaacgaaaacaaagtctcaatctttcattctctgtttgtctaaagtctgtacattcttcactttctcgagttgggtttctttcttgaatttggtttcttgggtttgattttgtttttcaagtggatattgctatttattgggtggtgatattgagacccttttgttagttttgtatattggtttttgaggtggatgtagtttttttaggggttttagggtttggttattgaaaactcatatggcaaggttggcttctggcaatctggatttataagattctgtttttcttgttgacacagtacaggatcaaaagggttggatttttgttacttgtcaatatcttcttattttgtgatagctagtccttttgcattaggattgcatatctttattctatctacttcattgtctctctatatattgccatcctatccggggagagacagattcaattgttttattgtccttctcattctcattagaatcaaagtcttgacatacaatcctttcacaattgtgaaatttgattccttagtgaccatctattgtagctgtttcatatttgtttcgttcaagctaattctgttgttagatttgagacaaaagaaggccccgcttccaattacagaccactttcttgttttggttttagctaagatatggatataagcaatgaggccagtgttgaccctttcaaaatcggaccttcatcgatcattggtaggacaattgctttcagagttctgttctgtaaatcaatctcacatttgaggcaaaaaatctttcatgtgttgttgaattacatttatagagttggtgaatttgtggcgcctatgttatcatggtttcatccaaggaatccacaagggatattggccatgatgacgataattgcatttttattgaaaagatatgcgaatgttaaattgagggccgaaacagcgtataggaggaaattttggaggaatacgatgagaactgcgttgacatacgaggagtggtttcatgctgctaaaatgcttgataaagagaccccaaagatgcatgaatgtgatctctatgatgaagaactagtcaggaacaagcttcaagagctccaccaccgtcgccaagagggatgtcttagagatataatcttttttatgagagccgatcttgtaagaaatctcggtaatatgtgtaaccctgagcttcacaagggtaggcttcaagtgcccaagctcataaaggaatatattgacgaggtctcaactcagttaagaatggtttgtgactccgattcagaggagctttcgttggaagaaaagcttgctttcatgcatgaaacgagacatgcttttgggagaacagctttgcttctgagtggaggtgcttcacttggagcgtttcatgtgggtgtggttaaaacactggtggagcacaagcttatgccccgaataattgctggttctagtgtggggtcaattatgtgttcagttgttgccaccagatcgtggccagagctgcaaagtttttttgaggattcctggcactcgtttcagttttttgaccaattgggtggaattttcacagttgtgaagagggtcatgagacaaggagctgttcatgaaatccggcagttgcaatggatgttaaggcatcttacaagtaatcttacatttcaagaagcttatgacatgactggtcgaattcttgggatcacagtttgctcacctaggaagcatgagccccctagatgccttaattaccttacttcccctcatgttgttatatggagtgcagtcactgcttcttgtgcttttcctggcctttttgaagcccaggaactaatggcaaaggacagaagtggggaacttgtgccttatcacccaccctttaatctggatcctgaagaaggatctgatgcacctatgcgtaggtggagggatggtagcctggagattgatttaccaatgatacaattgaaggaactattcaatgtcaatcattttattgtaagtcaagcgaatcctcacattgctccattgttgagactgaaggatatagtcagggcatatgggggtagctttgctgccaagcttgctcatctcgctgagatggaggtaaaacatagatgcaatcaggtattggaacttggttttccattaggtggacttgccaagctttttgctcaagaatgggaaggtgatgttactgttgttatgcctgccacactcgctcagtactcaaaaattattcaaaacccaaatcacttggagcttcaaaaggcatcaaaccaaggcagaaggtgcacatgggagaagctttctgccataaaagctaattgtggtattgagcttgctcttgatgagtgtgtttctgttctgaaccacatgcgtagactcaaaaggagtgctgagagagctgctgctgcttctcatggccaagcaagctctgcgagcacattgagatttagtgcttcaaaaagaattccttcttggaattgcatcgcaagagaaaactcaacaggctcacttgaagaagacttccttgctgatgttgcttcaacattccatcaaggagttggtgtggctggaggaacttctactggtaggaatttgagaacacaacgcaacctacatcatgatggaagtgatagtgaatctgaaagtgtagatttgaattcttggacaagatctggcgggcctttgatgaggactgcttctgcaaataagttcattgactttgtccaaagtctggatgttgattctgagctaaggaaaggcttcatggctcatcctaactcgcctggggctcagatgggaggcagggatccatataatcagatctcaagagtgacaaccccagatagaaattcagaaagtgagtttgatcagagagattttagcaatagaaattctactggtggttctagcattacagtcaccgaaggagattttttgcagcctgaaagaatccataacgggtttgtgctgaatattgtaaagaaagaagatttggcacatcccaataggatccatgatttggagaattacaatagtgaagttcctgaatgtgttcagcttgattgtcctgaaaaggacatggatgctagctcagaatcggactatgctgcagaggaagacgactcccctgcaacagattccttgcataaatcagcttccactcttgatcacacagatgattctgtcgttcatgacattcaggagaagcatgtcgtggatggttaactttgagtttcttctgcattactgtaccaaaatattgggtggagttgattcccgggttactgtcaatcaaaggtttccgactttccgtcacaactggagtatcatagacgagatttagaatctgtttattttttattttaaaaatatttttgaaaaaaattttgattttattttgattttatttttgttttaaattaatatttttttggtgtttttcatattattttgatatgttgatattaaaaataaatttttaatatcaattattcaatcagatatatttttaagtaaaacaagacagtttgaaaagtaatcggaacttttaaaaggttgctcttagtagtgaattataaaaaacaattgaaagcaatctggcagcgtcaggctattgctgttgtaaactaattttgtgcgcatactatgcaacaattgtaatccacatgcttagatttcagccaacgagatggaatttgaccctc

SEQ ID NO: 167 - DNA, 2490 bp, Medicago truncatula
atggatcgtataagtaatgaagccactgttgatctttttccaatcggtccttcaggaattcttgcccgaacaattgcattcagagtccttttctgcaaatccatttcacatttaaggtatcaattattcttaactttattcgattcgtttcatagatttagaaaattctggggacccattatatcatccttgcatccaaaaaaccctcaagggatattagccatcatcaccattctcgctttcttgttaaaacgttacagtaatgttaaagtaagagctgaattagcatacaggagaaaattttggagaaatatgatgagatcagctttgacttatgaggagtgggctcatgcagctaagatgcttgataaagagacgacattgaagacgatgaatgaatccgatttttacgatgtagaattggttaggaataaggttcaagagttacgacatcgtagacaagaggggtctcttagagatattatcttttgtatgagagctgatcttgttagaaatttaggtaatatgtgtaaccctcagcttcataaaggtaggcttcatgtgccgagacagattaaggagtatattgatgaggtggcgatgcagttgagaatggtttgtcattctgattccgaggagctttctttggaagaaaagcttgctttcatgcatgaaactagacacgcgtttgggaggacggctttgttgttgagtggtggtgcttctcttggagcttttcatgtcggtgtagttaaaaccttggtggaacataaacttatgccgaggataatttctggttcgagtgtaggatccattatgtgctctattgttgctactaggtcttggcctgagcttcaaagcttttttgaagattcgttgcactcgttacagttttttgatcaaatgggtgggatttttacgattgtcaagagggttacaacatttggtgcagttcatgagatcagacagttgcagattatgttgaggcatctaacgagcaatcttacatttcaagaagcttacgacatgacaggtcgagttcttgggattacagtttgctccccaaggaagcatgaaccgcctagatgtcttaactacttgacttcaccccatgttgttatatggagtgcagtcacagcttcttgtgcctttcctggtctttttgaggctcaggaattgatggcaaaggatagaagtggagagattgttccttaccatcctccatttaatttgggtcctgaagagggttcctcacaagtgcggcgttggagggatggtagcttggagatcgatctacctatgatgcagttgaaagaattgttcaatgtcaatcattttattgttagtcaggccaatcctcatattgcgccattattgagattaaaagaatttgtacgagcttatggaggtaattttgctgccaagctggctcatctggtagagatggaggttaaacatcgatgtaatcaaatactggaacttggttttccattaggtggacttgccaagctgtttgctcaggactgggaaggtgatgtgacagttgttatgcctgctactcttgctcagtactcaaaaattatccagaacccttcttatgtggagcttcagaaggcagctaaccaagggagaagatgcacttgggagaagctttcagccattaaagcaaattgtggaattgagcttgctcttgatgagtgtgttgcaattctcaatcatatgagaagactcaaaagaagtgccgagagagctgcttctgcttctcatggtctttctagtactgtcaaatttagtgcttcaaaaagaattccatcatggaatgtcattgcgcgagagaattctacaggatctcttgaagactttcttgcagacactgctgcttcatttcatcacggggttagtagttccagtggagccacgggtaaaaattccaagcaccaccgcagcatgcatgatgtaagtgacagtgaatccgaaagtgctgaattgaatacctggaccagatctggtggtcctttgatgagaactgcttcggcagatatgttcaccgactttgtccaaaacttagaagttgatactgaactaaacagaggaatgggaactaattttagccctcgtgattcccagtatcacagtcccagattaacaacaccggatagatgctccgagaactcagaacccgatcagagagaaaatggcaacaaggttgtcatgaatggatctagcataatggtaactgaaggtgatcttttgcagcctgagagaatccataatggaattgtgtttaatgttgtcaagaaagaagacttaacaccttcaagtaggagtcatgattatgatagtgaaattgctgagtgtctccaaattgaatgtccagggaaggagatggatgatgctgctagctcagcttcagaaaacggagatgacgattctgcaacagctaggcccctaactgaaacaccagactctaatcctacagataattcctga

SEQ ID NO: 168 - DNA, 2783 bp, Glycine max
atggatcatattagtaatgaggccagtgttgaccgttttccaattggtccttctggcattcttggtaggacaattgctttcagggttcttttttgcaagtctatctcacattttaggcaccacatatttattgtgttgttagatctcttctataggtttagggggggtttggcatcctttatatcatggttgcatcccaggaaccctcaagggatattggcaatgatgacaattgttgctttcttgttgaaacgatacacaaatgtgaaatcaagggctgaaatggcatataggaggaagttttggagaaacatgatgagaagtgctttgacctatgaggagtgggctcatgcagctaagatgcttgataaagagacaacaaagatgaatgaatcagacctttatgatgtggaattggtgaggaacaagcttcaagagctccgccaccgtcgacaagagggatctctcggagatataatgttttttatgcgtgccgatcttattagaaatttaggtaatatgtgtaaccctgaactacacaagggtaggcttcaggtgcctaaattaatcaaggagtacattgatgaagtaacgactcaattgagaatggtctgtgattctgattcagaggagctatcattggaagaaaagcttgctttcatgcatgaaactaggcatgcatttgggaggactgctttgctgttaagtgggggtgcctctcttggagcttctcatgtgggtgtagttaaaacactggtagaacataaactcatgcctaggataattgctggttcaagtgtgggatccattatgtgtgctgttgttgccactaggacttggcctgagctccagagcttttttgaggattcatggcactcattgcaattttttgatcaaatgggtgggatttttgcagttgttaagagagtcacaacattgggtgctgttcatgagatcagacagttgcaaatgatgttgaggcatctaacaagcaaccttacatttcaagaagcttatgacatgacaggcagaattcttgggattactgtttgttccccaaggaagcatgaaccgcctagatgtcttaactacttgacttcaccccatgtggttatatggagtgcagtaaccgcttcttgtgcctttcctggcctttttgaggctcaagaattgatggcaaaggatagaagtggagagattgttccttaccaccctccttttaacttaggccctgaagagggctccacaccagtgcgccgttggagggatggtagcttggagattgatttacctatgatgcagttgaaagaactattcaatgtcaatcattttatagttagtcaggccaaccctcatattgcaccactattgagattgaaagaatttgtgcggacttatgggggcaactttgctgccaagcttgctcatcttgtggagatggaggtgaaacataggtgtcatcaaatactggaacttggttttccattaggtggacttgctaaattgtttgctcaagactgggaaggtgatgtgactgttgttattcccgcaactcttgctcagtacaccaaaattatacagaacccttcttatggagagcttcaaaaggcagccaaccaagggagaagatgtacctgggagaaactttcagccataaaagcaaattgtggcattgagcttgctcttgatgagtgtgttgtgattctcaatcatatgagaagactaaagagaattgctgagagagctgcttctgcctctcatggtttgtccagcactgtcaggttcagtgcttcaaaaagaattccttcgtggaattgcattgcacgagagaattcgaccggctcccttgaggaccttactgatgttgcctcctcattgcatcaaggcatcggcagttccagcagagccaatggcaaaacttggaagacccaccgtggcatacatgatggaagtgacagtgactctgaaagtgttgatttgcattcttggacaagaactggcgggcctttgatgagaactacttcagcaaatatgttcgttgattttctccaaaacttagaggttgatacggatcctaataaaggcttagtgagtcacactatccataatgattttcagtatcatagccccaggctcacaacactagataggaactctgatagcacagaatctgagccaagggaaactggcaacagggttgtcaatgtgtccagcatacttgtgaccgaaggtgatcttctgcagcctgaaaggatccataatgggattgtgtttaatgttgtcaagaaagaagacttgtcacccttaagtagtagcagtcatggttttgaaaattacaacattgaagttgctgaatgtgtccaagatgagtgtccagggaaggagatagatgctgctagctctgcatctgaacacggagatgatgaagaatccatgccagccaggtccttaactgacatgccagattacaattccattgatcatcattcgggcacagattcgggtatggatcaaagcattgttgacagttagtgtcaagtatcagttcttttccagtgacattttaatattttgttcctattgccctccatattgtaaatagtactcattctagacttggagaggtctttattcatgattttgatgggaatagcccaccaatttggtttgctcataaatgtaacaaagataaagagtttgtatacataaattccacgacaacattgatatttcttggttaccacttctcagatgaatgaaatggagacatggttttcataatt

SEQ ID NO: 169 - DNA, 2724 bp, Sorghum bicolor
atggatgacatcgccagcgaggcgccggtgggggcgttcgccatcggcccgtccacggcgctgggccgcgccgtcgcgctccgggtgctgctctgcggctccgcggcgcgcctgcggcaccgcctggccgcggcgctccgcgccgcgctgcccgtcgcggcggcgtggctgcacccgcgcgacaacacgcgcgggatcctgctcgccgtctgcgccgtcgcgctcctgctgcggggccgacgcggcagggccgggctgcgggcgagggtgcagtccgcctaccgccgcaagttctggcggaacatgatgcgcgccgcgctcacctacgaggagtgggcgcacgcggcgcggatgctggagcgcgaggccgccccgcgccgcgccagcgacgccgacctctacgacgaggagctcgtccgcaataagctccgcgagctcaggcaccggcgccacgagggatcgctcagggacatcgtcttctgcatgcgcgcggacctgctcaggaacctcggcaatatgtgcaaccccgaactgcacaaagggaggctgcaggtgcctagactcataaaggaatacattgaggaagtatctactcaactgaaaatggtctgtgattctgattcagatgagttgcctcttgaagagaaactcgcatttatgcatgagacaaggcatgcctttggtagaacagccttgctgctaagtggaggtgcttcattgggatcctttcatgtgggtgttgttaaaaccttggtagagcataaacttttgccaaggataatttcaggatcaagtgttggctcgataatgtgttctatagtagcaacaagatcatggcctgagctggagagcttttttgaagagtggcattccctgaaattttttgatcagatgggtggaatctttcctgtggttaaaagaattttgacgcaaggcgctgttcatgatataaggcacttgcaggtgcttttgagaaaccttaccagcaatttgacatttcaagaagcttatgacatgactggtcggattcttgttgtcaccgtgtgttctccaaggaagcatgagccgcctcgatgcctaaactatttaacatcacctcatgttcttatctggagtgcagtaacagcttcctgtgcttttcctggactttttgaggcccaagaattgatggcaaaagatagatttggtcaaaccattcctttccatgctccattcttattaggcatagaagaacgaactgttgctccaacccgccgctggagagatgggagcttagaaagcgatttacccatgaagcaattgaaggaactattcaatgtgaatcatttcatagtaagccaagccaatcctcacatagctccgctgttgagactaaaggaaatcgtcagggcttatggaggcagcttcgctgccaagcttgctgaacttgctgagatggaagtcaaacataggtgtaatcaagttttggaacttggatttcctctaggaggattagctaaattatttgctcaagattgggaaggcgatgttacagttgttatgccagccactcttgcgcagtattccaagatgatacagaacccatcttatgctgagcttcagaaggctgcgaatcaaggtaggagatgcacttgggaaaagctatcagccatcagggcaaattgtgctattgagcttgcactggatgaatgtgttgccctcctgaaccacttgcgtaggctaaagaggagtgcagaaagagcatccgcatcgcaaggatatggtccagcaatcaggttctgcccatctaggaggattccatcctggaatctcatagcaagagaaaattcaactggttctcttgaagaagaaatgcttacatctcctcaaggacctggaggagttgctggaacatctaccagaaaccagtatcctcagagaagtgcacatgagagcagcgacagtgaatctgagagtattgatttacactcttggacaagaagtggtggccctcttatgaggacaacctcagccaataaattcatcagctttgttcagaatcttgagatcgacacagaatccagaacaattccatcgagggaagacataactgatcttgtgacaccaaatgctggtaccttggcagctcatgcagtgagtagagaagcaatcgataggagcttggacaattcagctttagatatccatgataccagtacccctagatcgacatttggcccttcaacaagtattgtggtttctgaaggtgacttgttgcagcctgaaaagattgaaaatggtattttgtttaatgttgtaaggagggatactctgctcgggtctagtagtggagttgagtctcaaggatctcctcgggaaccagatgttgaaacagtacagacggagtgccttgatggcgtgtctacttctgatgatgatgatgacaaggaactaaatgccattgatgatggaggaactagtcccatgagcagaaataatctacaacatcaggggtcctcactggaagaaaaattataccatccctcttccttaaattctgaagacgagacaaacacaaacaaaccagaagctgcatcgatttttgatatatgtacagatatgcatccggcatctattagcctacctgaagggtcttcagaaaagacagaactggaaacaacaaagattcctgatgacaattcagctgttatgaatgatgaagttgcctcaggtgctggtaactaa

SEQ ID NO: 170 - DNA, 2985 bp, Zea mays
cattctctctctctctctcccttttcaatttcgggggctttatttctctcctcccacgccttgcatcttcttgatgcgttgcgtcccgactcgaggcagacatcggaggcgcgccactgacttagctcgcgatttctagatccgcaaccctgcgctgctcaactccgattcttttagttcggattcgggtagcagcagggcttcggtggcgatgacttgattgatacgaattggggatttcttgctgtttgcgcctctcttcgtatcggcgctgaagggctcagctcgagattagaacaatttgggttttggggtcttttcttcttctactactgctggtcaagttcacagaaatcgctggctccgtggtccaatggacgagtccggggaagcgagcgtcggctccttcaggatcgggccgtcgacgctgctgggccgcggggtggcgttccgcgtgctcctcttcagctcgctgtggcgcctgcgggcgcgcgcgtacgcggccatctcgcgcgtgcgcagcgcggcgctgccggtggcggcgtcctggctgcacctcaggaacagccacggcgtcctcctcatggccgtgctcctcgccctcttcctgaggaaactctcggccgcgcggtcgcgggcggcgctcgcgcgccggcgcaggcagcacgagaaggccatgctgcatgccgggacgtacgaggtctgggcgcgcgccgccaaggtgctcgacaagatgtctgagcaggtccacgaggcggatttctacgacgaggagctcatcaggaataggctcgaggaactccggagacggagggaggacgggtcgctccgggacgtggtgttctgtatgcgcggcgatcttgttaggaacttggggaacatgtgcaaccctgaacttcacaagggcaggctagaggttcctaagcttataaaggagtacattgaagaggtttctactcaactaagaatggtgtgcgaatctgacactgacgagttgctgttggaagagaaacttgcctttgttcaggagaccaggcatgcctttgggaggacagcgctactcttaagtgggggtgcttcactcgggtctttccatgtaggtgtagtgaaaacattggttgagcataagcttctgcctcggattatagcaggatcaagcgttggttccatcatatgttcgatcgttgctacccgtacatggcctgagattgagagcttcttcacagactcattacagaccttgcagtttttcgacaggatgggcggaatttttgcagtgatgaggcgtgtcaccacttatggtgcactgcatgacattagccagatgcaaaggcttttgagggatctcacaagtaacttaacatttcaagaggcttatgacatgaccggccgtgttcttgggatcaccgtttgctctcctagaaaaaatgagccaccccgctgcctcaactacctgacggcaccacatgttgttatttggagtgcagtaaccgcctcttgtgcatttcctgggctctttgaagctcaggaactgatggcaaaggataggttcggcaacatcgttcccttccatgcaccctttgccacagatcctgaacaaggtcctggagcatcgaagcgcaggtggagagacgggagcttggagatggatttacccatgatgagacttaaggagttgtttaatgtaaaccatttcattgtgagccaaactaaccctcacatttctccactcctccggatgaaagagcttgttagagcctatggagggcgctttgctggaaagcttgctcgtcttgctgaaatggaggttaagtatcgatgcaaccaaatcctagagatcggtcttccaatgggaggacttgcaaaattgtttgcccaggattgggagggtgatgtgaccatggttatgccagcaacacttgctcagtacttgaagatcattcagaatccaacatacgcggagctccaaatggctgccaaccaaggccgcaggtgcacatgggagaagctctccgcaatcagagcgaactgcgccattgaacttgcacttgacgaatccatagcggttctaaaccacaaacggaggctaaaacgaagcatggagaggacggcggcggcttcgcagggtcactctaactatgtccgacccaagactccgaggaggataccgtcatggagccgcatcagtcgagagaactctttggagtctctctcggaagagatctctgcggttgctgcttcgtccatgcagcaaggcgctgctcttgttgtcggcgcaccaccaacgactctttctcagcatgttcggcgcagttctcatgacggaagtgagagtgagtcagaaaccattgaccttaattcctggaccaggagtggagggcctctaatgaggacagcgtccgccgacaggttcatcagtttcatccataacattgagattgacacagaattaagtaggccctgtgctgtggaaggtgatgctgcaggtattttgtcagaatctaccttcccaaacggtccacgaccgaacaatagctcaagtgttagtatgccaggtagatgcacagaaaattctgggaccgagtcgtgcaacactgtcaacaccagagcttctactcccacaagcatggctgttcgtgaaggagatttgctgccgcctgaaagcactactgataatgtcctacttaacattgtgaaaagagacgccctgcaggatggtgtaactgaattggcggaaagctcctgcgctgaaggatatgcggcaaactgtgacaccgtctcagggctagactgctgaaggtaacaagacgctcgctgctgacttgagcaatcaacaattagctgatgattagattcttcttgattttgatgatgaaaggtcatttatatgtagctcactacagcaacgcagtgtaggaaaattgtacctgctcgatttaaactttaaagagcatgccatgagtagctttgttaatgttaatattc

SEQ ID NO: 171 - DNA, 1998 bp, Physcomitrella patens
atgaattacttagacactgacgccgacgctgcgctagagcatttcggcattggacctctgactttggcgcaaagagttgtggcctttcgcgtcctattttgtcgttgggtgaaagagcttcgtgttgccctcgcaaagaggctgcagcggacacggagggtatggagacaggtgttctatatgtggtttgggtggttgaaccctcgaaatcccagcgtccttctgttagctgccgttgtagcaaccatgctcatgagaagagcgaaggcagggtctcagaaagcagagattgcgtacagacggaagttctggtccaatttaatgagggcagctttgacgtatgaggaatgggctcatgcggcgcggatgctagagaaggagcagaatcggaggaaagattcagacttgtacgatgaggatttggtgcgttcgaagctcaacgatcttcgattgcgtcgtttggagggtggtgtggaggacattcttttctgcattagggccgatttagtgcgtaatttgggtaacatgtgcaatcccgaactgcacaaaggccggctacaaactccccccctcatccaggaatacatcaacgaagtgagataccatcttcgagctgtgtgtgggagcgactcggacagcttcacacttgacgaaaaaattgcttttattcatgaaacccgccatggttttggtcgcactgcacttcttctgagtggtggagcagctcttggagcgtttcatcttggggttgttcgaacccttgtcgagcatcgtttacttccccgagtgattgccggtgccagtgtgggatctgtcatatgctcatttgctgcaactcgaacttggacagagctccagagctttttcgaagacaccatgccccccatgcactttttcgaaaacatggggagcatttttgctattgcgcacaggcttctgactcgaggtgctgtgcatgaaattggtatgctgcaaaggaaaatgagacagctcattggggatttgacctttcaggaagcttacgatctatctggccgcgtgcttggaatctctgtatgctcacctcggagactcgagcctccgagatgtttaaattatttaacttctccccatgtagtcatttggagcgcagtcactgcatcctgcgcattcccaggcctttttgaagcacaggagctgatggcgaaggatcgaactggtcaacttgtaccctatcattcgccacctcaggttggccccgaggacaaggacatggaaaaggggattgggaagcggcgatggcgagacggcagtctggaaagcgatttgccaatgatgcagttgaaggaactgtttaatgtgaatcatttcattgtcagccaggcgaatccgcatattacaccatttttgaggttcaaggattttgttcgtgcatatggaggagatttcgctggaaaattggcacacttagcggagatggaggttaagcaccggtgcaagcagatgatggagatgggctttgaggtgtttggattggctaagctcttcgcacaagattgggaaggagatgtcacgattgtgatgccggccacttttgcccagtttgccaagatcatcacgaacctgacagccacagatcttcgcaaggcagtgatgcaaggccgacgctgcacctgggcgaagctatcagccattcaggccaactgtggcatagaattgatgctagacgaatgtgtctctgaattaaaccgtcgtaggaaagccctgcgtgaaatagagcgcagcgcaatgcagagcagccatggtgggatgcgcgggttatcaggaacaaagcgtatcccatcctggaacatcatcgcccgagagaattcctgcggttcgctagatgaagagagtcttcacgaggtgcggatcccacatgatggtagcgacagcgacgataatctggaccaaaatcagctttcgtggacgagagcaggtggcccgctcatgcggaccgcatcagcagccaaattcgtg

SEQ ID NO: 172 - DNA, 3439 bp, Hordeum vulgare
gatcgcagttagtttggcttgtacgtcgcgttccccttccacccttatctccttctccggctgaccgggacgccgcatttgtcccatccacggcacggcacggcacgggcacgggagggagaagaagaagcccagctcgactcctcctccgcctcctcctttcctctgatcccctccgtttgcccattccccagatcccagcacgccatgcccgggcgcgcaggcgccaagccgcaccgcgcgcatttctcttccgccctgctccgatccaaggccgcggaggtgacccagtgagctctcccgccacgcccgtccgtccgccggttcatcggtcgcccatggacgtcatcaccaacgaggcgcgcgtgggggcgttcgcgatcggcccgtccacggcggcgggccgggcgctcgcgctgcgcgtgctcctctgcggctccctggcgcggctgcggcaccgcctcgccgccgcgctgcgcgccgcggcgcccctggcggcggcctggctgcacccgcgccacaacacgcgggggatcctgctggccgtctgcgccgtcgcgctcctgctgcgcggccgcgggggccgcgccggggtgcgcgcgcgcgtgcagtccgcctaccgccgcaagttctggcgcaacatgatgcgcgccgcgctcacctacgaggagtgggcgcacgccgcgcggatgctcgagcgagagacgccgcgccgcgccaccgacgccgacctctacgacgaggagctcgtgcgcaacaagctccgcgagctcaggcaccgtcgccaggagggctcgctcagggacatcgtcttctgcatgcgcgccgacctgctcaggaaccttggtaacatgtgcaaccccgagctccacaagttgaggctgcaggtgcctaaactcatcaaggaatacattgaggaggtatctactcaactgaaaatggtttgcaattctgattcagacgagttacctctcgaggagaaactggcatttatgcatgagacaaggcatgcctttggtagatctgccttactgctaagtggaggagcttcatttgggtctttccatgtaggtgttgtgaaaaccttggtagagcataagcttctacctaggattatttcaggatcaagcgttggcgcaataatgtgtgctattgtcgccacaaggtcatggccagaactggagagtttttttgaggagtggcattccttgaaattctttgaccaaatgggtgggatctttcctgtatttaaaagaattttgacgcatggggctgttcatgacattaggcacttgcagacgcaattgagaaatcttacaagcaacttaacatttcaagaggcatatgacatgactggccgggttctcgttgttaccgtgtgttctccaagaaaacatgagccacctcgatgcctgaactatttgacgtcacctcacgttctcatctggagtgcggtaactgcttcctgtgctttccctggactttttgaggcccaggagttgatggccaaagatagattcggagaaacagttccttttcatgctccattcttgttgggcgtggaggaacgagctgatgctgctacacggcgatggagagatgggagcttagaaagtgatttgcccatgaagcagttgaaggaattattcaacgtaaatcacttcatagtaagccaagccaatcctcacattgctccattactgagactaaaggagatcatcagggcttatggaggcagctttgctgcaaagcttgctgaacttgctgagatggaagttaagcataggttcaatcaagttctggaacttggatttccattaggaggaatagctaagttatttgctcaacattgggaaggtgatgtgacaattgttatgccagccactcttgctcagtattcgaagatcatacagaatccttcgtattctgagcttcagaaagcagcaagtcagggtaggcgatgcacttgggaaaagctctctgccatcagggcaaactgcgctattgagcttgcattagatgaatgtgttgccctcctgaaccacatgcgtaggctgaagagaagtgcagaaagagcagccgcttcacaaggatatggtgctacaattagactctgtccatctagaaggattccgtcatggaatctcatagcaagagaaaattcaactggttctctcgatgaggagatgctcacatctcccactgttacaagccatcaagcagttggagggactgctgggccatctaacagaaatcaccatctccaacatagtatacatgatagcagtgacagtgaatctgagagtatagacttgaactcatggacgagaagtggtggccctctcatgaggacagcctcggctaataaattcatcagctttgttcagaaccttgagattgacccagagttcagaacaatttcaccaaaggggagtgaaggtgatattttgacaccgaatagtaacttgtttgctggtcacccaattggtagagagccagttgataatcatccaaggcctgttactcctggtaggacctcaggcaatacaggttccgatcctcatgatactcctgttcctaggtctccatttggtctttccgcgagtatcatggtccctgaaggtgacttgctgcagcctgaaaagattgagaatggtattttattcaatgttgtccgaagggatactctcctagcgtctactagcggagttgaacctcatggatcttcacatgaggcagatgtggaaactgtaccgaccgagtgcctttatggtgcttcggatgacgacgacaacgtggaactgaatgccaatgatgaagcgctatctgatcgtggagatcagagatcttcagttgcaggaaatctagattcgtccgcttccatggactgtcaagctgaagcaagtactactcgatcagaagctccatctctctttgatatctgtgtggagattcctccagcaaccatgaccacagaaaatagtcggcctgacgagccttcttcagacataagactggagactgtaaagacagaatgccctgatgagaattctgctgctgggaatgctgaagttgactcagttcctgccagtaaagaatcttcctattggtctcagacatcagaaattggacagcagcatcaagtggatatgggatctgtgaactcctgtactgtttcattttcagaagatgatagacatgtgagccttatttcgaacgagaaaccggtcactacttccagtggcggagctgagagtatgacatctggaagaagtgaagctgactagcatagaacttgcctgttgaccgacctaatgtttttctgtgttgggacttggtagtttgaacaattcagcttgatctgatccatgctatgtgtgcaatttaaactcgtgtcacgatcaaactgaattgtgtctatatgtaggtgttgtaatcc

SEQ ID NO: 173 - DNA, 3470 bp, Nicotiana benthamiana
gttatctgatccaaacttctgactttttctattttccgaatccctatgttttttaataaatccatctctgccattgcagtgatatattcatttattgttatcaccttcttcatttattggtccctctgtgttttccatatattgaaggagaaaacattaactttatgcgattttgtagtttttctggttgattcctacaaccccttttgacattgatcttgtgggttacaaaaaacattgaatctttatgtcaaaatttgatctttgtatttcattttaaattgaaatttgatttttgggggtattaaggattcttttgtcggttgattttgtgccttttttgccaagttcttgtcggtctctgagctgaatttccataatttgacaaaaagaaaaggctaaagcagaaaggttgggagtttctttctttgactttcagaaactaaggtattttctttgatctaattcttgttaatatctggttcaatctgattccgttgaatcttgtgaatagcctttgtttccctattgtcagaaaattatttccttttcactttcctcgactctcagaagttagtacaatctttgttctgctaaatcttgtgaataacctttagcttagagttttaggtatctgtatattgggttctcttaacatttagcctagaagccttctctaggattagtcccccttttcattgagatggatataagtaatgaggctacaattgacttcttttccattggacctactacgatattgggtcgaacaatcgcctttagagtgttgttctgtaaatcaatttcacaattgaagcatcacctatttcatttcttgatatattacttgtacaaattcaagaatggtttgtcatactacttgacacccttgatctcgtggttgcaccctcgtaatccacaaggaatattggcattggtaacgcttctcgccttcttgttgaggcgatacacgaatgtaaaaatcaaggctgagatggcctataggaggaagttttggaggaatatgatgagatctgcattgacttatgaggagtgggctcatgctgccaagatgctagataaagagacccctaaaatgaatgaggcagatctttatgatgtagaattagttcgaaataaactccaagagcttcgacatcgtaggcaagagggttctatgagggatatcatattctgtatgagagctgaccttgttaggaatcttggtaatatgtgtaatccagaacttcacaagggaaggcttcatgtgcctagactgattaaggattatattgatgaggtttcaactcagttgagaatggtatgcgactctgattcggaggagcttctcttggaagagaagcttgctttcatgcatgaaacaagacatgcctttggtaggacagctttgcttttaagtggaggtgcttctttaggagctttccatgtgggcgtggtgaaaacacttgtagaacacaaactgatgccacggataattgctggttcaagtgtcggctcgattatgtgctccatagttgcaactcgatcttggcctgagctccagagttttttcgaggactcctggcactctttgcaatttttcgatcagttgggtgggatttttactattttcaggagggtcatgacccagggtgctgtacatgagatcagacagctgcaggtgctgttacgtaatctcacgaataatcttactttccaagaagcctatgacatgactggtagagttctggggattactgtttgctcgcctaggaaacatgaacctcctagatgcttgaactacttgacttcacctcatgttgttatatggagtgccgttaccgcttcttgtgcctttcctggtctcttcgaagctcaagaacttatggcaaaggatagaagtggagatcttgttccatatcacccaccatttcatttgggtcctgatgccacttctagtgcatctgctcgtcgttggagggatggtagcttggaggttgatttgccaatgatgcagctaaaggagctcttcaatgtcaatcactttattgtgagccaggcgaatccgcatattgctccactgctgaggatcaaagagtttgtaagagcttatggaggcaactttgctgccaagcttgctcaacttacggaaatggaggtgaagcacagatgcaatcaggtattagaacttggttttcccttgggaggattagcaaagctttttgctcaagaatgggagggtgatgtaactgttgtaatgcctgccactctagctcagtactcaaaaatcatacagaatccctcgactctggagctgcaaaaagcagcaaatcaaggaagaaggtgcacttgggaaaaactctcagccatgaaagcaaactgtggaattgagcttgcacttgatgaatgcgttgctatactgaatcacatgcgtagactgaaaaggagtgctgagagggcggctgctgcttcacatggcttggcaagcactgtcagatttaacacttccagaagaattccttcttggaactgcattgcacgagagaactcaacaggctcccttgaagattttcttgcggatgttgctgcttcacatcatcaaggaggcagtggttcgggggcgcatgttaaccgtagttggcgaacgcaccggaatgcacatgatggtagtgacagtgagccggaaaatgtggaccttaattcttggacaagatcgggtggtcctttgatgaggacaacatcagctgataagtttattgactttgtccagaacttggaaattggttcgcgattgaacaaaggattgactattgacctcaacaatattattcctcagatggcaagcagggaccatttctccccgagcccaagggtaacaacacctgatagaagttcagatacagaatttgatcaaagagattttagttacagggtccctgcgagtagttcaagcattatggtaggcgaaggtgaccttctgcagcctgaaaggactaacagcggtattgtcttcaatgtggtaaggaaaggagacttgaccccatcgaacagaagccttgattcagaaaataatagttccgtgcaggatgcagttgctgagtgcgtgcaacttgaaagtccagaaaaggagatggatattagctcagtatcggaggatggtgagaatgatgttgggcaaggaagtagggtaaatgaagttgattgtagtaaaaatcgttcatcaatcggtgatggcaacgataagcaagttattgatacttgagagtttagctttgattattctacacaggccattcgaattattttttatactcaaatggagcttctttcagagctaacacactcagaattggggttgtaaatagtgcaagtagcaaatctgtaataaatgtttagtgtagtcatcacccttctactagttcaaagtggctcagttcaattcaaattcagaacttcgataattcatgttt

SEQ ID NO: 174 - DNA, 713 bp, Nicotiana benthamiana
tgtatgagagctgaccttgttaggaatcttggtaatatgtgtaatccagaacttcacaagggaaggcttcatgtgcctagactgattaaggattatattgatgaggtttcaactcagttgagaatggtatgcgactctgattcggaggagcttctcttggaagagaagcttgctttcatgcatgaaacaagacatgcctttggtaggacagctttgcttttaagtggaggtgcttctttaggagctttccatgtgggcgtggtgaaaacacttgtagaacacaaactgatgccacggataattgctggttcaagtgtcggctcgattatgtgctccatagttgcaactcgatcttggcctgagctccagagttttttcgaggactcctggcactctttgcaatttttcgatcagttgggtgggatttttactattttcaggagggtcatgacccagggtgctgtacatgagatcagacagctgcaggtgctgttacgtaatctcacgaataatcttactttccaagaagcctatgacatgactggtagagttctggggattactgtttgctcgcctaggaaacatgaacctcctagatgcttgaactacttgacttcacctcatgttgttatatggagtgccgttaccgcttcttgtgcctttcctggtctcttcgaagctcaagaacttatggcaaaggatagaagtggaga

SEQ ID NO: 175 - DNA, 1500 bp, Arabidopsis thaliana
cgaaaaaagaagtagaatatatatatatatatatatatatatatatatatatatatattcgtgtggacatcataaatgcctaaatgataatagttgatttcgagttttattttcgttacttccaatcaaattctccttgcaccatatttatttttttactgtgagaacatatataagtatatattggaattacgtatccgagaggtttttgcatatttcgtttatttattttcgatatccacactactgtattattaaaaatttgaaaaattcaactagggcttttcatcttctctagaattattcgtttatttatgtcgatgtccacactattattaaaataaaacgagaggatatggttggatcatccaagtttcgtttatgactctttgttcatttacaaacgtttagttttccacttaagttttgaaaagagttaatttccaatatattcggcacagtttttcaagtgtattcatctgttttttttttttttggttggctatatggtccaaattttgatttgcaatatgagattgcacagagagaacaatctttcattatgattaattattgtacaagtaacaaacaccaatctccgatatactttggctctttagcacattgttatgctagaagttagcggaaatctatatgttgttaaacgcagcgtttaaattgaacagtgtaatttaccttgaaattttaagactacatgctgtttagaatttcagatgaaaacatcttgatgttttagaaatccacgtgggaatagcgtaaaatcttatccaacgaacttattttggttttgttgtatttgtgcaagtcgtcacgctaatcgaaaaaagaaaagaaaaaaagaagccgtcatgatcggccatttctcggccgagtctgagtctgactctgcgtccgtgtcaccattatcagatcgagcctgtcttatctcgttgcgattccctatgcaaaaatcttcttcttttttttattcccccatttatctctgatctcttctctcttctcaagtaaacctctctgcttcacgtctcttcttttcttgtcgattttccccagataatcaggtaaataaggctactttcttatttgatctggtggtctttgtgttgaaatctctgggttttctctgttgatttcaaagttctctctttttttttttgtttactgggtgctgtgaaaaatgatcttgtcaaagtctcctcttttcatcgaattgaaactctaattagaaaaaagatcataacttttattaaaaaaatgagtttgctttgcttaattttgcgaattgcttcatagattcattgattagcctatttggggtaacaaaaaaaagctgacacggtttcagattccaaaaatagatcatgactctgtttcttctctgcagaggttttaataaatatatgcttcttctcatgagttctcgttttttttgtcaccttcgcagttgaaaacacacccaaattcatcttcgaatcaata

SEQ ID NO: 176 - DNA, 2871 bp, Artificial Sequence
  Nucleotide sequence of the complement of the pSSU-Oleosin gene in the T-DNA of pJP3502.  In order (complementary sequences): Glycine max Lectin terminator 348nt, 3' exon 255nt, UBQ10 intron 304nt, 5' exon 213nt, SSU promoter
ggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttg

SEQ ID NO: 177 - DNA, 1578 bp, Arabidopsis thaliana
gtcacacacacataaacactccacacgctctgcttcgtccaatcaccaaacacgctttaatgactctcacgttttcctcctccgccgcaaccgttgccgttgctgctgcaaccgtaacctcctccgctagggttccggtttatccactcgcttcgtcgactcttcgtggattagtatctttcagattaaccgcgaagaagctgtttctgccgcctcttcgttctcgcggcggcgttagtgtgagagccatgtctgagcttgttcaggataaagaatcgtccgtcgcggcgagcattgctttcaatgaagccgccggtgagacgccgagtgagcttagtcattcccgtactttcttggatgcgcgaagtgaacaagatcttttatctggtatcaagaaggaagctgaagctggaaggttgccagcaaatgttgcagcaggaatggaagaattgtattggaactacaaaaatgcagttttaagtagtggagcttccagggcagatgaaactgttgtatcaaacatgtctgttgcttttgatcgcatgcttcttggtgtggaggatccttatacttttaatccatatcataaagcagtcagagaaccatttgactactacatgtttgtccatacatacatccgtcctcttattgatttcaaaaattcgtacgttggaaatgcttctatattctctgagctggaagacaagattcgacagggacacaatatcgtgttgatatcaaaccatcaaagtgaagctgatccggctgtcatttctctattgcttgaagcacaatctcctttcataggagagaacattaaatgtgtggctggtgatcgagtcatcactgatcctctttgtaagccgttcagtatgggaaggaacctcatatgtgtttactcgaaaaagcacatgaatgatgatcctgagcttgttgacatgaaaagaaaagcaaacacacgaagcttaaaggagatggctacaatgctaaggtctggcggtcaacttatatggattgcaccaagcggtggaagggaccgcccgaatccttctactggggaatggtttcctgcaccctttgatgcttcttcggtagacaacatgagaagactggttgaacattctggcgctcctggacatatatatccaatgtctttgctttgctatgacatcatgccccctccaccccaggttgagaaagaaatcggagagaaaagattagttgggtttcacggtactggactatcaattgctcctgaaatcaacttctcagacgtcacagcagactgcgagagccctaatgaggcgaaagaagcatacagccaagctttgtacaagtcggtgaatgaacaatacgagatcttaaactctgcgattaaacacagaagaggagtagaagcatcaacttcaagggtctctttgtcacaaccttggaattagtctctcgttttagggtaacactttcaaaactcataaatcttctgtctcagaagttttgttgcaactgtatatatattgagagagagagcattgttctttcatttgcaggatacacaaacacaatcaatggaaaatactc

SEQ ID NO: 178 - protein, 459 aa, Arabidopsis thaliana
MTLTFSSSAATVAVAAATVTSSARVPVYPLASSTLRGLVSFRLTAKKLFLPPLRSRGGVSVRAMSELVQDKESSVAASIAFNEAAGETPSELSHSRTFLDARSEQDLLSGIKKEAEAGRLPANVAAGMEELYWNYKNAVLSSGASRADETVVSNMSVAFDRMLLGVEDPYTFNPYHKAVREPFDYYMFVHTYIRPLIDFKNSYVGNASIFSELEDKIRQGHNIVLISNHQSEADPAVISLLLEAQSPFIGENIKCVAGDRVITDPLCKPFSMGRNLICVYSKKHMNDDPELVDMKRKANTRSLKEMATMLRSGGQLIWIAPSGGRDRPNPSTGEWFPAPFDASSVDNMRRLVEHSGAPGHIYPMSLLCYDIMPPPPQVEKEIGEKRLVGFHGTGLSIAPEINFSDVTADCESPNEAKEAYSQALYKSVNEQYEILNSAIKHRRGVEASTSRVSLSQPWN

SEQ ID NO: 179 - DNA, 2455 bp, Artificial Sequence
  Populus trichocarpa
agtgcgggtgattgggtgaggagtgaagacgctgattttagaggttttgagagagtggcagtctgcagagaataggaatccgaccatatcctccaaaacccgcgctggactcagtcaccgccaatcatcaatcagccacccatcaacaccaaaaatccccgtccttttgatttccaccacataaaaatagcacactgctcctccttcactccattcctatcttaataataataataataataaagctcaactcttctcttctaagtcaagacatgatcctttccattcctgctccttcgtcggcattcttcacaactactaaaccgtctccaccttttcctagggtttctaaactctgcttcttaaccccctcatattctctttcccttcgttttagatccactgctcgacgctccacttcttttccttgtgtcctctcttctctcaaccttcacgcaatggctgaactcgttcaggataaagaagtcttcgcttctgctgaagttgattacagcaagaagaaaaacaggactcgttctcgctcgtttcttgatgcaacaactgaacaagagttactgtcgggaatcaggaaggaatcagaagcaggaaaacttccttcaaatgttgctgcaggaatgaaagatctgtatcagaactacaaaaccgcagttttgcaaagtggaattcccaacgcacatgagattgtattggaaaatatggctgctgcattggatcttatattctttgatgttgaggacccgtttatcttctcaccttatcacaaagctttgagaaagccatatgactactttgaatttggtcaaaagtatatccgtccattgattgattttagaaattcatatgtaggcaatgtttccattttcaatgaaattcaagagaagcttcggcagggtcacaatattgtcttgatatcaaaccaccaaactgaagcagatccagctgtcattgcactgttgcttgaaacatcaagccctcacattgctgaaaacttgatctatgttgctggggatagagttgtcacagatcctctttgcaagccattcagcatgggaaggaatcttatatgtgtatactcaaaaaagcacatgaatgatgaccctgaacattcagaggagaagagaaaagcaaatatccgaagtttgaaagagatggctttgcttttaaggggtggctcacaaatagtctggattgcaccaagtggtggcagggaccgtccagatcccttgtcaggagagtggtatccggcacactttgatgcttcttcagtagacaacatgagaaggcttgctgaacattctggagctccaggacatgtttatcctctggcactattatgccatgacatcatgccccctccgcctcaggtggaaaaggaaattggagagagaagagttatttcatttcatggagttggattatcagttgcaccagaaatcagcttctctgaagttacagcggcatatgaaaatcctgaagaggctaaggaggtatatacagaggctctgtataagtctgtgactgagcaatacaatgtgcttaaatctgctgtacatggaaaacaagggctaggggcgtccattccaactgtttctttgtcacagccatggaattagtcaaccttttctatacttgattaggccaatagttttgttatatagttctgcaactcctggaccacaattctagcggtccttctagtcaagtatgtgccaggagaagcttctctctccatgatgatatggatggctttttctggagatgcaatctaagctacaagtttttgctgtgcttacattctatcaaagccaaatctcacacaatatcttgaagccaaattcatctgaaacgcgagctgttccagaggttcaatttcaggtgtgcagataacagttcctagtaaacacaagagctagtcgtctgaggcgatatacatgtatattttctcaattttttggtggccgatcatattctttttacaccaattgctcaattgctactcatttttctccctcgttcaccttcaataactagaagttttcatgctataacacttgcacacagaagtactatgaacagagttggagcacattttgcctcttgactaaacaagacttgtttttagctgccacaccaaactttttatatgatgcaattatggtagtcgttttctcttgttttggtcaaaacccaaaccagctatagttgctacagccaatcgagagtggtgcatgtttgtttgtttttttttttttttttgtcctcagttatagtaaccatgttcaactgaactatgcatctcttaggacaccacctcttaagccccgtgatctaaccgtgttttcgaattttttttttttttttgggcttttggtttatttaaacgcagcagctttgacccaagttaaaacaaaaaaatctattaaaaaaattgtag

SEQ ID NO: 180 - DNA, 1389 bp, Artificial Sequence
  Jatropha curcas
atgacactttctgcttttccttccacattcctctttagaatacaatcgccatcaacgcctagggtttccatttccctcccttccttatcttcaaagctctgtttggttcctccctctttttctcctccttcgcttgctcttaaatcgagtgcgcgaaggaccatttgtccttgcttgctctcttctctcaacgccaacgtggctcaccttctcaaggaggaaaaagaagttgtggcttcggcttccggctgcgagaaggaggaggaaaagaagatggaacagcctagtcactcccgcactttcctgcatgccagaacggaacaagatttgctgtctggaattagaaaagaagcagaagcagggaggttgccttcaaatgttgcagcagggatggaagaattgtatcagaattatagaaatgcagtgatacaaagtggaacccccaatgcagaagagatcatactgtcaaatatggccgttgctttggatcgtataagcttggatgttgaggacccttttgtcttctcacattatcacagagcattgagagagccgtttgactactataacttcggtcaaaattatattcgtcctttggttgattttagaaattcttatgttggcaatatttcccttttccatgaagtggaagagaagcttcagcagggtcataatattgtcttgatgtcaaatcaccaaactgaagcagacccggctataattgcattgctgcttgagaaaacaaagccctatattgctgagaatttgatctatatagcaggtggtagagtcataacagatcctctttgcaagccattcagcatgggaaggaatcttatatgcgtgtactcaaaaaaacacatgaatgatgttcctgagcttactgagatgaagaaaagagcaaacatacggagtttgaaggagatggccattccattaaggggtgggtcacgaatagtgtggattgccccaagtggtggtagggaccgcccagatcatctgactggagaatggtatccagcaccatttgatgcttcttcagtggataacatgagaaggcttgctgaacattctggtgctcctgggcatatttatccattggcattattatgccatgacataatgccccctccccttcaggtgcaaaaggaaattggagagaaacgagtgatctcctttcatggggttggattatcaattgcaccgggaatcagcttctctgaaattgcgggtagttgtgaaaatcctgaagaggcaaagaacatttattcacaacttctgtatgattcagtgactgcgcaatacaacgtgcttaaatctgccataaatggcaaacgagggctagaggcttcaattccaactgtctctttgtcacaaccatggaattaa

SEQ ID NO: 181 - DNA, 1368 bp, Ricinus communis
atgattctttccattctttcccctacactaccatcgcctagggtttgtatttccatttcttctgtatcttcaaagctctctctagtccctgtctcttctttttctcttcctcctcctttggccatagtaagatggtcatcaaggtcctccatttgtccttgtttcttctcttcttctctcaacgccaatccagtccccgaactcctcaacgatgataagaagaagaacaacaacaacaacaagagcaagaagggaaagtgtactcctcactcccgcacttttcttgatgcaagaactgaacaagagttgctgtatggaattaggaaggaagcagatgcagggaggttgcctttaaacattgcagcagggatggaagaagtttatcggaattatagaaatgcagttttgcaaagtggaattccaaatgcaaaagaaatcatactgtcaaatatggctgttgcgttagatcgtatgtgcttggatgttgaggacccttttgtcttctcaccttatcataaagcactaagagaaccattcgattactataattttggtcaaaattatatccgtcctctgattgattttaggaattcatatgttggcaacatttcgcttttccatgaagttgagcagaagcttcagcagggtcacaatattattttgatgtcaaaccaccagactgaagcagatccagctgtcattgcattgttgcttgaaaaaacaaatccctacattgctgagaatttgatctacgttgcaggtgatagagttgtaacagatactctatgcaagccattcagcatgggaaggaatcttatatgtgtgtactcgaaaaaacacatggctgatgttcctgagcttactgagatgaagaaaaaagcaaacattcgcagtttaaaggagatggtcatgattttaagggatgggtctcaaattgtttggattgctccaagtggtggcagggaccgcccagattctttgactggagaatggtgtccagcaccctttgatgcttcttcagtggataacatgagaaggattactgaacattctggcgctccaggacatatttttccattagcgttgttatgccacgatatcatgccccctccacctgaggtacaaaaggaaattggagaaagaagaatgatctcctttcatggagctggattatctattgcacccgaaatcagcttctctgaaattgctgttgcttgcgaagatcatgaagaggctaagaacgcatatgcacaggttttatatgattctgtgactgagcaatacaatgtgcttaaatctgccatacatggaaaacaaggactagaggcatcaacttctaccgtctcattgtcgcaaccatgggattag

SEQ ID NO: 182 - DNA, 1344 bp, Helianthus annuus
atgtcgattctcccgtcttcttctcctactctcttcttctccaccgcaaaccctagggtttctgtttctctttcacttacttctacagtttctacatcttcatccgtgcgcagtcgctcgattttccggcattttccgtacctagcgttttctagggcagcgaatgccgccgcggagacgtttgaaggcaagaagtggtcgtcgtcctccgctacacaaccgatctccggatccgagctcggttactcgcatacattcatcgatgctctgtctgaacaagatcttctttctgtaattcaaagagaggtagaagctggagcactgccaaaacatatcgctcactcaatggaggaactctatcagaactacaaaaatgcggttttccaaagtggtaatccctgtgcagaagatactgtattgtcaaacatgcgtgtagcatttgatcgaatgttcttggatgtgaaggagcctttcgaattttcaccgtatcatgaagctattcgagagccttttaattactatatgtttggtcaaaattatattcgtcctctgatcaatttcagggaatcatatgttggcaacgtctctcttttcagtgaaatggaagaacaactgaagcagggtgaaaatgtaattttgatctcaaaccaccaatccgaagcagatccagctgtcattgccttgttgcttgaaacaacaaatccttatatttccgagaacataatctatgtggcaggggacagagttataacggatcctctttgtaagcctttcagcatgggaaggaacttgctgtgcgtatattcaaaaaaacatatgaacgatgttcctgagcttgctgatatgaaaaggagagcaaatacaagaagtttaaaagagatggctttgcttttgaggggtggatcaaaaataatatggattgcaccaagtggtggaagggacaggcctgatcccgtcacaaatcaatggtttccagcaccattcgatgccagttctctggacaacatgagaaggcttgtggaccatgctggtgtggtgggtcatatatatcctttagccatactatgccatgacatcatgccccctcctcctcaggttgagaaagaaattggagagaaaaggttgatatcttttcatggcactggaatatcagttgcacctgaagttgatttccaaaacgccactgcttcttgtggatcccccgaggaggccaaggcagtttattcacaggcactttatgattcagtgtgcgagcaatacaacgtgctacaatccgccataaatggagcaaaaggcttagaagcatcaacatcaagtgtctcattgtcgcaacctgttgactag

SEQ ID NO: 183 - DNA, 1374 bp, Medicago truncatula
atgtttacaacaccattttcttctccttcaaccgcatttttctctccacctaaagcctcatattcttcttcttcttcttcttcttcttcttcttcttcgttacctcttcgtagttctttcactttttatcatcttcgatttaatgcaacaacttcttcttcttctgtaacaacttctggaacttcttcttcttcatattgttctcctcttgctttcaattctaataataaaaaacctaaagaaatttctgctaatatggcggcttcttctgtttcttctcgcactttcctcaatgccagaaatgaacaagatgttctttctggaattaagaaggaagtagaagccggaactttgccccccactattgctgaagggatggaagaattgtaccttaactataaaagtgcagttgttaaaagtggagatcccaaagcagatgagattgtattgtcaaatatgactgctttattagatcgcatatttttggatgtgaaggagccttttgtctttgaagcacaccataaagcaaagagagagccttttgactactacatgtttggccaaaattatattcgtcccttagttgatttcaacacttcttacgttggcaacatgccccttttcatacaaatggaagagcaacttaagcagggacacaatattatcttgatgtcaaaccaccaaagtgaagctgatccagctattattgcattgctgcttgaaatgcgacttccacatattgctgaaaacttgatttatgtggcaggagatagagttataaccgatcctctatgcaagcccttcagtattggcaggaatctgatctgtgtttattcaaaaaagcacatgcttgatgatccagcacttgtagagacgaaaagaaaagcaaatacacgaagtctgaaggaaatggccacgcttttaaggagtggatcacaaataatttggattgccccaagcggtggtagggatcgaccagttgccaactctggggaatgggcaccggcaccctttgattcttcttcagtggacaatatgcgaaggcttgtcgatcattcaggtccaccaggtcatatctatcctatggcaatactgtgccatgacataatgccccctccactaaaggttgaaaaagaaattggggagaaaagaattatatcatatcatgggactggcatatcacttgctccagaaataagcttttccgacatcactgcttcttgtgaaaatcctgaaaaggctaaagaagcatactcgaaagccttgtatgattctgtgactagtcaatatgatgtgctggagtctgccatacacggcaaaaaaggattagaagcatcaactcccgcagtttccttgtcgcagccatggaagtag

SEQ ID NO: 184 - DNA, 1967 bp, Glycine max
ggctgagactgaggagcggatcctatctctctttcacacactctccttctctttcgtatgaagaatgagcacgaccggttcttcggcttaccactgtgtggcacacctcccaaataataagactatgtttatgctctctacgccgccaacaaccacattcttcgctacgcctagggttcttccgtttctctcttcaaaactttcttcttcttcttcttcttctactgcgtcgtcctcgccttgttgctcctccatcactcccaaggttaaatccaaagataacaacaattgctacctcgtctccgctaaacattctcccgctaacatgtccgcttcggtttcgtcacgcaccttcctcaacgctcggaacgaacaagagcttctagctggaatcaggaaagaagtagaagctggatctctgcctgctaatgttgctgcaggaatggaagaagtgtacaataactataaaagtgcagttatccaaagtggagatcccaagtcaaaggagattgtattgtcgaatatgattgctttattggatcgcatattcttggatgtgacggatccttttgtctttcaaccacaccacaaagcaaagagagagccttttgactactacgtgtttggtcagaattatatccgtcctttagttgatttcaaaaattcttatgttggcaacatgccccttttcattgaaatggaagagaaacttaagcagggacacaacatcatcttgatgtcaaatcaccaaactgaagctgatccagccatcattgctttgctgctcgaaacacgactcccatatattgctgaaaacatgacctatgtagcaggagatagagttataactgatcctctgtccaaaccattcagtattggcaggaatctcatttgtgtttactctaaaaagcacatgcttgatgatccagctcttgtagagatgaaaagaaatgcaaatatacgagctctgaaggaaatggctatgcttttaaggagtggatcacaaatagtctggattgccccaagtggtggaagggatcgcccagatccccacaccggagaatgggcaccggcaccctttgatacttcttcggtagataatatgagaagacttgttgaacattctggtccaccgggccatgtatatcctttggcgatattgtgccatgatataatgccccctccactaaaggttgagaaagaaattggggagaaaagaattatatcctttcatgggactggcatatcagtggctccagcattaagcttttctgaaactactgctactagtgaaaatcctgaaaaggctaaggaggtattcacaaaagccctgtatgattctgtgacggagcaatataatgtgctgaaatctgcaatacatggcaaaaaaggatttgaagcatcaactccagtagtttctttgtcacagtcatggaagtagatgaaatctgcatttcttcattgcaatttgctctgatgcagaagcaagttacaagacttcagtcaaacaatttcaactgattcacttctgagggactgcctattactacaccggtcaccgaatgatttagcttgttggaagtttgcagtcaaatacatatttttcatttcatttttccttttgctcttggttgccgttatcagcattcaattcatctggaatctgtttcagttcagaaggttcaaattctgctgcttactgtacaggtctctcttagttcggtgtcagatttggttcgttgactgataaaatactaaattttttacctacaattttgtgatcaggcttagctagctgaatagataaaatataattggttccatttgtattttaagtcaactttgttccattatagatgaatagatgttagtattacatgttcagacggggtcagtgaataaactggtccaaatgctaatgcaaaattattcatattggtaaaataaaagctctacagttaccgtta

SEQ ID NO: 185 - DNA, 1674 bp, Carthamus tinctorius
tctctctctctcacacacaacacacaaaacacacactactgctactttctctctctactacactctcctctcgctatgtcgatcttcttctctccttcctcccctactctcttcttctccaccacaaacgcaaatcctagggtttctccttcatcttcaccttcttctgccttcactcctcctctgtcttcttctcgcctccgcccgattctccgggggtttccgtgcctcgcgttctctgcgccggcgaatgccgcccatggcacggcggagaccgtccacggcaataagtggccgtcaccgtcgtcctcctcctctgctgctacgcaaccgtccgctggatccgaccacggtcactctcgtacattcatcgatgctcgttccgaacaagatcttctttctggaattcaaagagagttggaagctggaacactgccaaaacatattgctcaagcaatggaggagctatatcagaactacaaaaatgcagttctccaaagtgcggctcctcatgcagaagatattgtgttgtcaaacatgcgtgtagcgtttgatcgtatgttcttggatgtgaaggagccgtttgaattttcaccatatcatgaagctattttggaaccttttaactactatatgtttggtcaaaattatattcggcctttggtcaatttcagggaatcatacgttggcaatgtctccgttttcggtgtaatggaagagcagcttaagcagggtgacaaggtggttttgatctcaaaccatcaaacagaagcagatccagctgttattgccttgatgcttgaaacaacaaacccccatatttctgagaacataatctacgtggcaggggatagagtaataacagatcctctttgcaagcctttcagcatgggaaggaatctgttgtgcgtgtattcaaaaaagcatatgaatgatgttcctgagcttgctgagatgaaaaaaagatcaaatacaagaagtttaaaagggaggatggctttgcttttgaggggcggatctaaaataatatggattgcgccaagtggtggcagggacaggccagatcctatcacaaatcagtggtttccggcaccgtttgatgccacttcgcttgacaacatgagaaggctcgtggaccatgctggtttggtgggtcacatatatcctttagccatattgtgccatgacatcatgccccctcctcttcaggttgagaaagaaattggagagaagagttggatctcttttcatggcaccggaatatcagtggcaccggaaattaatttccaagaagttactgcctcttgtgggtcccccgaggaggcgaaggcagcttattcacaggcactctatgattccgtgtgtgaacaatacaaggtgctacattctgcggtacatggaggaaaagggttagaagcatcaacaccaagtgtctcgttgtcacaacccttgcagtttctcgattagtctcttggtttagaggaggtgaaagcatattcttttgtttagatgacataggtgtatagatgataccgaagaatagatgtacaaacaagtgatagaaagatgtatgtctaatcaaaaaatgttttctgcatcttgtaaagggatcttcaaaacagaccttttattttagctgcagcaaccaatatatcaaaacaggtttttcttttt

SEQ ID NO: 186 - DNA, 1893 bp, Solanum tuberosum
cgcacatattcatttcactcactttctttcccgaccctttctctctctaaagctctccagtctgtggtgatgttgatcctctcagcggcttcgtcttcttcttcctccttcatgctttcttccgcttcgtcttcttctgcacgcattccgaggcagttatcttcattttcaacttgtgttccagtagtagtaacaactgtttcttctgcagcaacttcgactctatttccgatttcctgcttcggtgtgaaatcgaggactgttgggattcggaagctgcggtgtgccgttttttgtgcttcgaaggtacgtggaatggcagaaatgattgaagatgccatgacggtttctgcttctgagagccatgagcttccgcagtcccgagacttccttgacgcacgcactggagaagacttgctatctgctgttcaaaaagctgtggaagatgaaaaactgccgcttaatgttgctgaaggaatggaggatttgtatcagaactatcggaatgcagttttacaaagtggagtccccaaagcagatgaggccactttgtataacatggctcttgtatttgatcgtgtttttgtggatgtgaaggatccttttgaattctcgccatatcataaggccattcgtgaaccttttgactattacaagtttggtcaaaattatatccgccagctagttgatttcaggagttcttatgttgggaatatctcagttttcggtgaaatggcagagaagcttaaacagggtgataatgttgtcttgatgtcaaaccatcaaagtgaagccgatcctgcgattattgcactcttgattgaatcaaagctcccagatattgctgagaacattatttatgttgctggagatagagttattactgatcctctttgcaagccattcagcatgggaaggaatctcctgtgtgtttattcgaaaaaacatatgaatgatgaccccgaacttgctgagatgaaaaagagagcaaacacaagaagcttgaaggagatggctttgctattgaggggtggatcaaaaataatatggattgctcctagtggtggaagagataggccagaccctgttacaaacgaatggtatccagcaccatttgatgcttccgcgacagacaacatgaggaggcttgtacaacatgctggtgtccctggtcacatttatcctctagcaattttgtgccatgatattatgccccctcccgcccaggttgagaaaaatatcggggagaaaagagttgtatcttttcatggagctggcatatctgtggcacccaaaattgattttcatgaggttgctggtgctttggaggaccctgaggctaagatggtatatacaaaggcactttatgactctgtaagccagcagtacaatgtgctaaattctgctatacatggcaaacaaggactgaaggcatcaatacctagtgtttcattatcacaaccatggcagtagcttctcttccaactttatttttcatatcttgttgctgtagtcagttttgcagatgtttgtttggcagttacaatcaaatcacaaggattacactcacaatctttccacataccacgcttgcatgtggttagtctatgcagaaagttgatacaaacaaagtaattctcgaagttacagcaaacataacctgaaggaatttttttggcagggttagataattcttttgacacgaatgtacagttgctttacattgtatttataccaaatgttagatccaaatttgttagtaatgatagctttcaagtactcaattctgactttttaaggtcaagtgttagtagctatcctagattgctgctcatcttgcctttgaagtggtaatccaatttgttgagaaatataataaatgatgctctgcta

SEQ ID NO: 187 - DNA, 2016 bp, Oryza sativa
gggctggagatggagatggagatggagatggagggtgggtttggcacaaatcccgaagcgctccggcgaccactcccaacccagtccccactagggtaacaaccccctttcggattaggtttctagaagcttcttctatgcaggcgccgccgctcgcctcctcgccgtcgccggcgtggaccgccatcctgcccgcgccggcgaggctctgctgctcccgccgcggcgccctccgcctcgaagccaaggccgcctggaggccggcggcccgagggccgcgggtgccggccaagggcgccgtcctcgcctccgaggtggtgggcccctctcccctcctcgacgcgcgcaacgagcaagagctcattttgcatatcagaaaggaagtggagaaagggaagctgcctgcagatgtcgctgccaatctagaagagctatactacaactacaaggacgcggttatgcagagcagggatccaaatgcacacgacatcgtgctttcaaacatggtggccctgttcgattgtgttctgctcgatgtagagaatccgtttacctttccgccttatcacaaagctgtcagggaaccattcgactattacatgtttggtcagaactacattaggccccttgtagactatagaaattcatatgttggtaatatatccattttccaagacatggaacagaagctccaacagggccataatgttgttctgatgtctaaccatcagacagaagcagatccagcaatcattgctttgctgcttgaaagaagcaacccatggatcagcgaaaacatagtttatgttgctggtgatagggttgttacagatcctctctgcaagccatttagtatgggaagaaacctcatttgtgtgtactcaaaaaagcatatgaatgattttcctgagctagttgatatgaagaggagggcaaatactcgtagtctgaaggaaatggctttacttttacgtggcggttcacagataatttggatagcaccaagtggtggtagagatcgtccggatcctttgacaggagaatggcatccggcaccatttgatgcatctgcagtggacaacatgaggaggcttctggagcattctggtgttcctgggcacatatatccactctcactgctctgctatgaggttatgcctccaccacagaaggttgagaaagagattggtgagcaaagggttatatccttccatggtgtaggcttgtcagtaactgaagagataaagtacagcgacattacggttcatacccaaaatgtcgacgagtgcagagagaaattctcagagtcattgtacaactcagtcgttgatcagtataatgcgctcaaatctgctatctttagaggtcgaggagcagattcatcggacagtgccatctcactctcacaaccatggcgatgaaactccgctttctcagttttgttctgtctggatttctcaatgaagttaccttcatttcttttcgacacagcagatgaactgctgccgacattgcaatttttcctggcagaaccttttaaacttcggtatcctaacccatactaatcatgaaggggaggctgttactgtcatgcaaatcttgcctagtatgatgattttacccagctgaatcccagccacacatgatgcgttcgttcattgtttgcacacaaatattattgcgtcatatgagtattctttgggtcagaactgcacagcaacgcggcctgggcactcaatctggcatgttgtctatggggtgcatgcttgttaacagaagaagcccaacatgtgggattttgttttttgcggttaatttttttcctgttttccttttgttccatgtatatatattcgattttgatctccaggtttggagatacaatggtcaaagtgttatgatagtctcttagtttgttgcctcgaagttatactcgggcgcaacatgtctgactgatattctgatgatgttactcgtttctgaacttcctgacgccaatatggtgcttggatgttg

SEQ ID NO: 188 - DNA, 1888 bp, Sorghum bicolor
atgcacgcgccgccgctggtcgcgttcgcagggggcgcctgccccgccaccgccgcctcgtcctcgccgtcgccctggctggcctcgccgcgggccgccatcctcgccgcgccggcgaggctcctacggtcccgccgcggggcacttcggctggaagccaaggccgcgtggagggctgccggagggggacggggcccgagggtcccggccaagggcgctgtgctcgcctcctatatgggcgccgaggaggtggtgggaccttcgtcgctgctcgacgaggaagagctcatttcacatatcagaaaggaactggataatggaaaactccctgcagatgttgccagtaatctggaggagttgtattataattacaggaatgctgttctgcaaaatggagatcctaatgcatatgagatcatgctttcaaatatgacggctttgtttgatcgtgttctactggatgtacagaatccatttacctttccaccttatcacaaagctgtgcgagaaccgttcgactattacatgtttggtcagaactacattaggcctctggtagatttcaggaactcctatgttggcaacatttcactttttcatgacatggaagagaagctgcaccagggccacaatgttgttttgatgtctaaccatcagacagaagcagatccagcaattatctccttgcttcttgaaaaaaccaatccatggattagtgaaaacatagtttatgttgctggagatagggttgttatggatccactttgcaagccatttagcatgggaagaaatctcatttgcgtgtactcgaaaaagcatatgaatgattttcctgagctagttgagatgaagaggagatcaaatacccgaagtctcaaggaaatggccttgcttttacgtggtggctcacagttaatttggattgcaccaagtggtggtagagaccgcccaaatccttcaacaggagaatggtacccggcgccattcgattcatctgcagtggacaatatgaggaggcttctggagcatgctggcgttcctgggcacatatatccactatcattgctgtgctatgaggttatgcctccaccacaacaggttgagaaagagattggtgagcagagggtgatatccttccatggagtaggcttgtcagtaactgaagaaataaaatatggggatattactgctcataccaagaatgctgatgagggaagggagctattcacaaatactttgtacaactcagttgttaatcagtacgatgtgctcaaatctgctatctttagagatcgtggagcagctgtatcaaacaatgtcatctcattgtcacaaccatggagatgaatgttagctttctcagtttgggtccagatttattactgaagttaccttttcagaagagcaggtgaactgccattgtgcaatttcactggagaaactcttgaactttaatctttttgataccactcgactttatcagtcatggtggagcctgtcattgtcatgcagatccttgctaagaagtctgtggacaactgttggttggtcaagggtgactggtgattctgcacatagggatcctcgtaactgttgcatgcggtcgtccgcaaattactggttgctcagcaacgtgctggttgggcactgaggaatccgtcaggttgcatcctttttgccttgacgtcaatttgtgtagttgaaggttgaagtgataaattgttttatcttgtcttgtcatcatgtatataggctcgagtcttttttggctccacatttttttggagatataaaagcagcaggagttatgacatgccctcagtcggccctccttgttgaaaccctttggatgtaacctgtctatttcttatatatactcactgaaagt

SEQ ID NO: 189 - DNA, 2046 bp, Zea mays
gaggattcatctcgtgtcgacgacgccttcgccctctccgagtctccgtccgtcttccgcgtcctccgcagctggactcgtgcgctattccccaggacgctactcccactagggttttcggattaggtttctagaaccttccaccgccgcctctccatgcacgcgccgccgctggtcacgttcgcagggggcgcctgccccaccaccgcctccgcttcgccgtcgccctggttggcctcgccgcgggacgccatctttgccgcgccggcgaggcccctacggtcccgccgcgggacactccggctggaagctaaggccgcgtggagggctgccggagggggacggggcccgcgggtcccggccaagggcgctgtgctcgcctcctatatgggcgccgaggaggtggtgggaccatcgtcgctgcttgacgaggaagagttcatttctcacatcagaaaggaactggataatggaaaacttcctgcagatgttgccagtaacctggaggagctgtattataattacaggaatgcggttctgcaaaatggagatccaaatgcatatgaggtcatgctttcaaatatgatgaccttgtttgatcgtgttctactggatgtacagaatccatttaactttccaccttatcataaagctttgcgagaaccgttcgactattacatgtttggtcagaactacattaggcctctggtagatttcaggaactcctatgttggcaacatttcccttttccatgatatcgaagagaatctccaccagggccacaatgttgttttgatgtctaaccatcagtcagaagcagatccagcaattattgccttgcttcttgaaaaaaccaatccttggattagtgaaaacatagtttatgttgctggcgatagggttgttaccgatccgctttgcaagccatttagcatgggaagaaatctcatttgcgtgtactcgaaaaagcatatgaatgatttccctgagctaattgagatgaagaggagatcaaatactcgaagtctcaaggaaatggcattgcttttacgtggtggttcacagttaatttggattgcaccgagtggtggtagagaccgcccaaatccctcatcaggagaatggtacccggcaccattcgattcatctgcagtggacaatatgaggaggcttctggagcatgctggtgttcctgggcacatatatccactatcattgctgtgctatgaggttatgcctccaccacaacaggttgagaaggagattggtgagcagagggtgatatccttccatggagcaggcttgtcagtaactgaagaaataaactatggagacattactgctcataccaagaatgctgatgagggaagggagctattcacaaataccttgtacaactcagttgttaaccagtacaatgtgctcaaatctgctatctttagagatcgtggagcagctgtatcaaacaatgtcatctcactgtcacaaccatggcgatgaatgtccagtttcgttactgaagttaccttttcaaaagagcaggtgaactatcattgtgcaattttgctgggagaaactcttgaacttaaatctttttgatatcactagacttcatcaatcatggtggagcctgttattgtcatgcagatgctcgctaagaagtctgcaactgttggttggtcaagggtgattggcgattttgcacatacggatccgcagttactgctgcctcaggttgctcagcaatgtgctgctggttgggcaccgaggaatccatcaggttgcatcctttttgcccggacgtcgatttgtgcagttgaagtggtaaacgtttttttatcttgtttcgtcatcatgtatatacgtaggcttgagtcattgttggctccacattttttggagatataaatgcggtaggagttatgagatgtccacagtcggccctcccttgttgaattcctttggatgtatcctctctctttcgtacatgcactcactgaaagtcaatgcaaatatctcgtgtttctagtaaaaaaaaaaaaaaaa

SEQ ID NO: 190 - DNA, 1994 bp, Hordeum vulgare
gagaaaccaagaagcgagaatcggcaccgttcccgtcgccgcctcgtcgcctccgtcgcccgtcttccttttccgccgattcgtgcccaccaccaccactctccttcccactggctagggttttcggtttctagaacctcacgcccgcccgctccatgcaagccccgccgctcgccgcgctcgccggaggcgcctgggcctctcaccgacctgccatactagcggcgccggcgggcctccgccgtcccaggcgctgcgccctccggctgcccgcgtggagggcggccggaggcggccgggccccgcggctaccggtcaagggcgccgtgctcgcctccgacacgggggcggacgaggaggtcgcggggccatcgcccctgctcgacgtgcgcagcgagcaagagttcgttctacgcgtcaggaaggaagtggagagagggaagttgcgtccagatgttgctgacaactttgaaaacctgtactgcaattacaagaatgcggtgctacaaaatggggatccaaatgcatatcagatcatgctttccaacatgatggatttatttgaccgcgttctgctagatgcagagaatccatttacgtttcagccttatcacaaggccatcagagaaccgtttgactattacactttcggtcagaactacattaggccactggtagattttaggaactcttatgtcggtaacatttctgtattcagtgatatggagaagcagctccggcagggtcataatgttgttctgatgtctaatcatcagacagaagcggatccagcagttattgccttgtcacttgaaagaagcaatccgtggattagcgagaacatagtttatgttgctggggatagggttcttacagatcctctttgcaagccatttagcatgggaagaaacctcctttgtgtgtactcaaaaaagcatatgaatgattttcctgagctaattgagatgaagaggagggcaaacactcgaagtctcaaggaaatggctttgcttttacgtgggggttcacatataatttggatagctccgagtggcggtagagaccgtcctgaccccttgactggagaatggcacccggcgccatttgatgcatctgcagtggataatatgaggaggcttctggagcattctggcgttcctgggcacatatatccattatcattgctatgctatgagattatgcctccaccacaacagattgagaaagagattggtgagcaaagggtgatatccttccatggtgtaggcttgtcagtagctgaagaaataaagtatggggatgttactgctcaatctcagaatgctgatgaggcaagggggaacttctcagaggctctgtacagttcagttgttgatcaatataatgtcctcaagtctgctatctttagagaccgtggagcagtttcgtcgaaccctgccatctcactctcgcaaccatggcggtgaaactaagctttctcaggcctggatttctcatttcttttcgacagagcagatgaactgctatagtgcaacgttgtggttttttgctgggatggccttaaactttgatgtcgtcacagttaggatgaggccctgcagatcctgtaagttgttgaagtcgcgggaaggaaaaaccgtgtgatatgctgctacaccgtgttcatgtagtgacaggaagtctgcggctgttgtcaggtctaaatcctaaatagcacggcggaacccagcagcagatgatgcatgtgttcatcttttgtgaacagctactgctgtatcagatggctatcatctgggccagattggtccagcaaatacagattggcccctggatcctggcagtcgtctggatcaaaatgctgatatttctttttgtgctcgtcttatttttttgattagttttgtgtacatattaattcttttgctccaaaatttggagacacatgacatgatatatacagagcagagcccaatatgtgtcgccttcctgttaac

SEQ ID NO: 191 - DNA, 1936 bp, Physcomitrella patens
ggacgagcggagtggagagctatggcggcagcagctggttccgctggcgtggtatgttggtctagggcagagaagcagcatgccccggtcagggggggtggaactagtgttaccagtagtaccagtggcagcggccatgcgtcgttgaaagggagcttcgatcggctccaaggtaaccgccttctgccgcaagccttgactatgccgtcgctgtttcgggcgaaacgcaatggcagaaggacgccggggaatgccgtgaccaatttcgggaaatctgaattccatcgtgaaattagtgggagtacgcgggcgaccacgcaggtggctgaagccaccacagctggtcttagggagaccattgaggaccgcgctattatcgacggtcattctcacagttttgaaggaattcaatcggaagaagagttgatgcaggtaattgaaaaggaggtggaatccggtcggctgccgaagcgtgctggcgcgggaatggtagagttgtatcgcaattatcgagatgctgtagtgagcagtggcgtagaaaatgcgatggatattgttgtgaaagtcatgtcaactgtgttggaccggattcttctgcagttcgaggagccattcacatttggatcgcaccacaagagaatggtggagccgtatgattactacacatttggtcagaactatgtgcgtcctctcctagatttcaggaactcttaccttgggaacttaaagatctttgaccagatagagaagaacctgaaagaggggcacaacgtcatttttctatccaatcaccagactgaggcagatcctgctgttatggcgctgttgcttgagcactctcacccctatttggcagagaacttgacctatgtggctggagacagggttgtgctggatccattctgcaaaccttttagtatgggcaggaatctcttgtgcgtgtattcaaaaaagcacattcacgatgtaccggaccttgctgaaatgaaaatcaaagctaatgcgaagactttgagacagatgacgatcctgctgaggcagggaggtcaattattatgggtagcacccagtggtggacgcgatcgccctgatcctgagaccaacgaatgggttcctgcacattttgactcgtctgctgtggagaatatgaagcgactatctgacattgtccgagtacctgctcatttacatgccctatcattactatgttttgagattatgccacctcctgtccaggtacaaaaggagctaggagagcgaagagcagtaggatttagcggagttggtctagccgtttccgagcaactagattatgattccattgcgaagttagtcgacgattccaaaaatgcgaaggatgccttttcggatgcggcatggagcgaagtcaatgatatgtataacgtgttaaaagaagcaatttatggtgaccaaggttgtgctgttagcacagattccttgagactggaacagccctggtttgatggaagcaggcgaactgattgaaaataggtcatttgaagttttatgtaaaagtatgaagcatccttattgctttttacgctgtctaagctccaaggatgtaagaattcagcagcgtgtataatggctacattgtcatgtgatattctttctgattcgtgcgacacgatggccatgcctgctcaatccttgtcaccaggcgtctcagtaggaaacggtggtactgattgctgtctgtccgacttgatttagtagctcggattctgcgtactggataacttggtctggtaatagggaccgatcctatcggtgaggagtttgtgatatagatcaatactgcactttgttacaatcggaatagatgcattcattattcatccaagccaacacatcctgagttggagcataagttgaagcactcctcaacttcattgaaaggagatttctcactacg

SEQ ID NO: 192 - DNA, 2260 bp, Chlamydomonas reinhardtii
gaagaatgctgcacgcgactcagcagcgcgcggtcgctggccgtcgcccgttctcgggtgcgcgcgcgtcgaaccgcgttgttgctcacgcggctgcgaccgtcgccaccagtctgccgaccgttgacgtccagttccaccagcctaagctggcgggcgtgaccaacgagcagcagttcaaggcggtaatcaaggggctggtcgctcagggcaagttccctccgcagctggagcccgcttgggattacttctatgacaactacaagaaggctgtcaccagcagtggcgtcgctggggccgatgagaagcttgtcacccaggtgcaagccagcattctggacaatgtcctgaaccaggcggtgaacccctacaccttcccctctttccacacccgcctaattgagccctacaactactatgacttcggtcagcgctacgtcgcgaccctcatcgacttccagaactccgtgctgggtttccgcgagcgtttcgaccgcgttcaggagctgctggaccagaagcacaacgttgttatcctcgcgaaccaccagacggaggccgaccccggtgtgtttgcccatatgctggcgaagacgcaccctaagctggcgacggatgtgatctacgtcgctggcgaccgcgttgtcaccgatccgatgtgcaagcccttctccatgggccgcaacctcttctgcgtgcactccaagaagcacatggacgacgctccggagctgaaggccgcaaagatggagaccaaccgcaagacgctggtcgccatgcaacgcaagctgaacgagggcggcacgctcatgtggatcgcccccagcggcggccgcgaccgccccaacgccaacgacgagtgggtgcccgataactttgatcccgccgccgtggagctgatgcgcaacctggtgcagcgcgccaagcagccgggccacctgatgcccatgtccatgttcagctaccccatgatgccgccgcccaagaccgtggacaagtccattggcgagcgccgcctcacggccttcacgggcgtgggcatctccctgtgcgaggagctggacgtggcggccatcatcgcggccagcggctcggaggagaaggagcagaaggctctggccaaggccgcgcacgacgcggtgaaggagtcgtacgcggtgctgtccaaggccatccaggatcccgccttccgcgccacccgcaaggagttcacacagccctggatggcgtaaggaggcgggagcagcagcggcagtggcggcagcgacagcagtggcggatcttgggggcacgaggcagcagctagcacacgcggggccggtggcggcagcggacgggagaggtgctggtgcggatgctggtgccaggagcagtgcgtctatgcctggcggcggcgccgaccggtgctgaagctgttgtcggcagcagcagcgggaacttgcgctggcgatggctgaaggtgatgtggctggccgtacagcaaatgctgctgtcacgcattgtcagcggcggccgctgggtccgctgggatgtgaggagtgcgagatcagcataggccaggcgggtgggttgcggtgccgctgccgacacgtcgcacaggaaggagcaggaagggtgcggctgagcaccagggtcacttggggcctgtgttagcgtgaccgggcctgaaaggggtatttgtctggggagcagctcgacgcacattcgtgggattgcttaggaaggagcgttgggatggctgtgccgcgcggtgtgcccagcacgttgactggctctgacccgggtcaaccaatgcgttgcggccgttgcaacgatgcttctaatcagcgtgagatggagtgtacgaatgcaggtatgacgatgaccatagacgagtgtgagcgtgtgtatctgtggattggacacggttcattcaatccattcgtaccggacatatgactatacaagaccgtgtggagtgtgtttgtgcgctcaagactggacgaagtgggcgctcccgatgtggagcgcggtgctcgcgggttgtgtgtcttgccgcaacgcaagcagcgtggcgtggtgtggatgattcttgcattatgactggggttttaccggcggcccagagcgtgtgtggagcaaaagcaaaaacaggaacaaggagccgtgtgcacaattcgcgcggatggtggtggctggggatctgacaggagagtgccaacggcggccgggtgctagtgcttgaacatcatgtgatattgtgattgtacaaatggactgc

SEQ ID NO: 193 - protein, 362 aa, Arabidopsis thaliana
MLKLSCNVTDSKLQRSLLFFSHSYRSDPVNFIRRRIVSCSQTKKTGLVPLRAVVSADQGSVVQGLATLADQLRLGSLTEDGLSYKEKFVVRSYEVGSNKTATVETIANLLQEVGCNHAQSVGFSTDGFATTTTMRKLHLIWVTARMHIEIYKYPAWGDVVEIETWCQSEGRIGTRRDWILKDSVTGEVTGRATSKWVMMNQDTRRLQKVSDDVRDEYLVFCPQEPRLAFPEENNRSLKKIPKLEDPAQYSMIGLKPRRADLDMNQHVNNVTYIGWVLESIPQEIVDTHELQVITLDYRRECQQDDVVDSLTTTTSEIGGTNGSATSGTQGHNDSQFLHLLRLSGDGQEINRGTTLWRKKPSS

SEQ ID NO: 194 - protein, 367 aa, Arabidopsis thaliana
MLKLSCNVTDHIHNLFSNSRRIFVPVHRQTRPISCFQLKKEPLRAILSADHGNSSVRVADTVSGTSPADRLRFGRLMEDGFSYKEKFIVRSYEVGINKTATIETIANLLQEVACNHVQNVGFSTDGFATTLTMRKLHLIWVTARMHIEIYKYPAWSDVVEIETWCQSEGRIGTRRDWILKDCATGEVIGRATSKWVMMNQDTRRLQRVTDEVRDEYLVFCPPEPRLAFPEENNSSLKKIPKLEDPAQYSMLGLKPRRADLDMNQHVNNVTYIGWVLESIPQEIIDTHELKVITLDYRRECQQDDIVDSLTTSETPNEVVSKLTGTNGSTTSSKREHNESHFLHILRLSENGQEINRGRTQWRKKSSR

SEQ ID NO: 195 - protein, 412 aa, Arabidopsis thaliana
MVATSATSSFFPVPSSSLDPNGKGNKIGSTNLAGLNSAPNSGRMKVKPNAQAPPKINGKKVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 196 - protein, 345 aa, Arabidopsis thaliana; identical to SEQ ID NO: 60

SEQ ID NO: 197 - protein, 303 aa, Arabidopsis thaliana; identical to SEQ ID NO: 57

SEQ ID NO: 198 - protein, 445 aa, Avena sativa
MKRSPPPAPPAAPPPPQPSPSSSSPACSPSPSSSSCPSSSDSSSIVIPRKRARTQKAASGKPKAKASAKRPKKDASRSSKETDANGAAAAAGKRSSIYRGVTRHRWTGRFEAHLWDKNCFTSVQNKKKGRQVYLGAYDTEDAAARAYDLAALKYWGSETILNFSVEDYAKEMPEMEAVSREEYLAALRRRSSGFSRGVSKYRGVARHHHNGRWEARIGRVLGNKYLYLGTFDTQEEAAKAYDLAAIEYRGANAVTNFDISCYLDQPQLLAQLQQGPQVVPALQEELQHDVQHDLQNDNAVQELNSGEVQMPGAMDEPIALDDSTECINTPFEFDFSVEENLWSPCMDYELDAILGNNTSNSANMNEWFNDSTFESNIGCLFEGCSNIDDCSSSKHCADLAAFDFFKEGDDNDFSNMEMEITPQANDVSCPPNDVSCPPKMITVCN

SEQ ID NO: 199 - protein, 420 aa, Sorghum bicolor; identical to SEQ ID NO: 34

SEQ ID NO: 200 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLTTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 201 - protein, 430 aa, Triadica sebifera
MASSSSDPVLKAELGSSGGGCSSGGGGESSEAVIANDQLLLYRGLKKPKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNMSREEYLASLRRKSSGFSRGISKYRGLSSRWESSVGRMPGSEYFSSINYVDDPAAESEYVGSLCFERKIDLTSYIKWWGLNKTRQAESISKSAEETKPGCAEDIGGELKTTEWAIQPTEPYQMPRLGMPVHVKKHKGSKISALSVLSQSAAFKSLQEKASKKQENSTDNDENENKNTNTNKIDYGKAVETSASHDSSNERPVTALGMSGGLSLKRNVYQLTPFLSAPLLTNYGTIDQLVDPILWASLVPVLPTGLSRNPEVTKTETSSTYTFFRPEE

SEQ ID NO: 202 - DNA, 1531 bp, Solanum tuberosum
ttttaaatcattgttttattttctctttctttttacaggtataaaaggtgaaaattgaagcaagattgattgcaagctatgtgtcaccacgttattgatactttggaagaaatttttacttatatgtctttgtttaggagtaatatttgatatgttttagttagattttcttgtcatttatgctttagtataattttagttatttttattatatgatcatgggtgaattttgatacaaatatttttgtcattaaataaattaatttatcacaacttgattactttcagtgacaaaaaatgtattgtcgtagtacccttttttgttgaatatgaataattttttttattttgtgacaattgtaattgtcactacttatgataatatttagtgacatatatgtcgtcggtaaaagcaaacactttcagtgacaaaataatagatttaatcacaaaattattaaccttttttataataataaatttatccctaatttatacatttaaggacaaagtattttttttatatataaaaaatagtctttagtgacgatcgtagtgttgagtctagaaatcataatgttgaatctagaaaaatctcatgcagtgtaaaataaacctcaaaaaggacgttcagtccatagagggggtgtatgtgacaccccaacctcagcaaaagaaaacctcccttcaacaaggacatttgcggtgctaaacaatttcaagtctcatcacacatatatttattatataatactaataaagaatagaaaaggaaaggtaaacatcattaaatcgtctttgtatatttttagtgacaactgattgacgaaatctttttcgtcacacaaaatttttagtgacgaaacatgatttatagatgatgaaattatttgtccctcataatctaatttgttgtagtgatcattactcctttgtttgttttatttgtcatgttagtccattaaaaaaaaatatctctcttcttatgtacgtgaatggttggaacggatctattatataatactaataaagaatagaaaaaggaaagtgagtgaggttcgagggagagaatctgtttaatatcagagtcgatcatgtgtcaattttatcgatatgaccctaacttcaactgagtttaaccaattccgataaggcgagaaatatcatagtattgagtctagaaaaatctcatgtagtgtggggtaaacctcagcaaggacgttgagtccatagaggggggtgtatgtgacaccccaacctcagcaaaagaaaacctcccctcaagaaggacatttgcggtgctaaacaatttcaagtctcatcacacatatatatatattatataatactaataaataatagaaaaaggaaaggtaaacatcactaacgacagttgcggtgcaaactgagtgaggtaataaacagcactaacttttattggttatgtcaaactcaaagtaaaatttctcaacttgtttacgtgcctatatataccatgcttgttatatgctcaaagcaccaacaaaattta

SEQ ID NO: 203 - DNA, 20 bp, Artificial Sequence
  Oligonucleotide primer
cactcgtgctttccatcatc

SEQ ID NO: 204 - DNA, 20 bp, Artificial Sequence
  Oligonucleotide primer
gaaggctgagcaacaagagg

SEQ ID NO: 205 - DNA, 18 bp, Artificial Sequence
  Oligonucleotide primer
ggcgattttggattctgc

SEQ ID NO: 206 - DNA, 20 bp, Artificial Sequence
  Oligonucleotide primer
cccaacccttccgtatacat

SEQ ID NO: 207 - DNA, 1970 bp, Zea mays
ggtaccttttttcccagagataaatgtggaatagctctacaaacaaacggcatgatgctgacacttggatggcgaccttgcaatcccaagaactattgcatacggttgccagtcgacaaatatctacgccatgcatggctacggtcggaatacaccgtagcggcgggtaactcgccgataccgtccacgtgtccttggatgcccggtcgctgatacttctggtcttctggacatgcaccaagacaatcaagtgattcaaccttaatttaacataatataaataatacgtaacatccaactgacgtgttcacctatagagaatattccttctgattctactttcagaatgatgccgttgccgtgtatcgagcaagtactctcactcgaagtatcttatctcccacatccagcacaaaaatcttctgttcgtggcaaatcttgtggcggttgaacgaaagaatgctatataagtagctatagagaacgtattatgtgtaaaccaaccgttcagtgtaaatcgtgtgtaaatagtcatgttaattttttggcggcagatcaagtacaaactgtatgcctcggataaacatgtacaaaccacaacactggccactagatctatatccaacgttcataaccatccatccctctctgctgcactctgcaaacaagcacccccatctcgtagcaacatcttgtctccgacaagctctcgatgtagtggaggccctccaccgcaatatcctagtgtatgatgttggagaagcgactcctaaataatggtggcaagatgttgctaggtttgtagccatagcctcaatctaagatcatcccaagccatgggacctgattctacgaggcctacaaccaggcatgacacgtcgtctacccactcttgtgcatcatcggtcacttgatctgacttggttcctaaccacttaccctaggttccaaagccctaagtttctcgtatattgttagtcattcttagtgggagttttatgtgtatttcattcctgttaaatagcatgccaactaagcaaacatgatgatataatatgcaatctaataaaaagatatatgagtgggtttcataaaaaagggagagagtttcatgaggagtgaaactctgaatacagatactgatatgacagctttaaaagtagtgttatgaaatcatcattgagaaatggtattagcactcaatcgatttctacgctgtcaattgtcatgagcacaattttcacccaaagaggcacaccagcaatgtccgcttgtagtgtccgagacgttgctccatcgccgtcgtcttgtttctgtgcgctccattcaatgcggcaagtggctcaatcccaagcggtcgtcgcctcccagccccagcagcaaaatatcttcccatgcggccatgccttgaaaattggaatagattctctagattcaccgccgcgtcatcttcactactttctcactggcccaatcagcatctccttctccgagctcaatcatgctcagtcaagcgtcaccaatggcgtcacggttggttttgtcactgtctgcatgcaagggtattttgcttcgcaagtgtaaatggaaaatggatctaaacaactgcactgcaccaattttggaacgcggaaccgagagtctgtttgggttcgtttgaaacgcgctgatgtttctcattttttaatagatgtagttacctgatactatttaagttggacgatcaaacgactgtgtcaagtgtgattaagaaaagcatcgaaaataaaatttatcgccataaaaagttaaaaacagtggataatagtaggacctcataatagaaaaaattatcaaacggaatggaggggcccaacgcagtatatagcagccgggtggtgccggacatccgacgctcgtgccagcaggccattcttctcgccttactccctcacagaacccagtaaaatatcgccagtcccgccgtcgag

SEQ ID NO: 208 - DNA, 584 bp, Aeluropus littoralis
cccaagcttgaccgatgcacacgctacctgccaaggctccctccatccgcactctgcatcgtcgcttcggcgtaaacttccacgtagtacttgtacgattctagctagacccagtgcgcccaccctaccgccggcgagcgggcccccatctcgcgccaggcttccatgcgggtccaccgtggaccagccctacgccgaaccgagcccatccctccaccctttcaccgccaagcgggacccgcgttggacctttccgcttggctggcccccaccagcgtccacgcgggccaacggcctcgcgaaatggatctccacacgacaaaccaaaacgagaagaaaataaatggaaaggaaagaaacggatcgccacgcgttccagaggcgtccgctaaccacccgattatgcttgcgcagcgtgcgtaacctcgtcgtggggttaatccgggtggccggatcgggaaagccacggcctttataacccatccctgccggatcgaaccggtaccggaaacaaaaacagggggagaaaaaaagttcttcgcgaggaaggaaaaggaaaagtcgcgtgccgtcctcgcccacag

SEQ ID NO: 209 - DNA, 928 bp, Agrobacterium rhizogenes
ttagcgaaaggatgtcaaaaaaggatgcccataattgggaggagtggggtaaagcttaaagttggcccgctattggatttcgcgaaagcggcattggcaaacgtggagattgctgcattcaagatactttttctattttctggttaagatgtaaagtattgccacaatcatattaattactaacattgtatatgtaatatagtgcggaaattatctatgccaaaatgatgtattaataatagcaataataatatgtgttaatctttttcaatcgggaatacgtttaagcgattatcgtgttgaataaattattccaaaaggaaatacatggttttggagaacctgctatagatatatgccaaatttacactagtttagtgggtgcaaaactattatctctgtttctgagtttaataaaaaataaataagcagggcgaatagcagttagcctaagaaggaatggtggccatgtacgtgcttttaagagaccctataataaattgccagctgtgttgctttggtgccgacaggcctaacgtggggtttagcttgacaaagtagcgcctttccgcagcataaataaaggtaggcgggtgcgtcccattattaaaggaaaaagcaaaagctgagattccatagaccacaaaccaccattattggaggacagaacctattccctcacgtgggtcgctagctttaaacctaataagtaaaaacaattaaaagcaggcaggtgtcccttctatattcgcacaacgaggcgacgtggagcatcgacagccgcatccattaattaataaatttgtggacctatacctaactcaaatatttttattatttgctccaatacgctaagagctctggattataaatagtttggatgcttcgagttatgggtacaagcaacctgtttcctactttgttacca

SEQ ID NO: 210 - DNA, 732 bp, Artificial
  hpRNAi construct containing a 732bp fragment
aatgcagttttacaaagtggagtacccaaagcagatgagatcattttgtataacatggctcttgtgttggatcgtatttttgtggatgtgaaggatgcttttgagttctcaccacatcataaggccattcgtgaaccttttgactattacaagtttggccaaaattatatccgccctttacttgatttcaggagttcttatgttggcaatatatcagtttttggtgaaatagaagagaagctcaagcagggcgttaatgttgttttgatgtcaaaccaccaaagtgaagcagatccagcggttattgctctgttgcttgaatcgaggcacccatacattgctgagaacataatttatgttgcaggagatagagttattactgatcctctttgcaagccattcagcatgggaaggaatctcctgtgtgtttattcgaaaaaacatatgggtgatgaccccaaacttgtcgagaagaaaaggagagcaaacacaagaagcttgaaggagatggctgtgctattgaggggtggatcaaaactaatatggattgctcctagtggtggaagagataggccaaaccctgttacaaaagaatggtatccagcgccatttgatgcttcttcaacagacaacatgagaaggcttgtagaacatgctggtgtccctggtcacatttatcctctagcaatattatgctatgatattatgccccctccgccccaggttgagaaa

SEQ ID NO: 211 - protein, 512 aa, Elaeis guineensis
MAVSKNPETLAPDQEPSKESDLRRRPASSPSSTAASPAVPDSSSRTSSSITGSWTTALDGDSGAGAVRIGDPKDRIGEANDIGEKKKACSGEVPVGFVDRPSAPVHVRVVESPLSSDTIFQQSHAGLLNLCVVVLIAVNSRLIIENLMKYGLLIGSGFFFSSRLLRDWPLLICSLTLPVFPLGSYMVEKLAYKKFISEPVVVSLHVILIIATIMYPVFVILRCDSPILSGINLMLFVSSICLKLVSYAHANYDLRSSSNSIDKGIHKSQGVSFKSLVYFIMAPTLCYQPSYPRTTCIRKGWVICQLVKLVIFTGVMGFIIEQYIDPIIKNSQHPLKGNVLNAMERVLKLSIPTLYVWLCVFYCTFHLWLNILAELLCFGDREFYKDWWNAKTIEEYWRMWNMPVHKWMLRHVYLPCIRNGIPKGVAMVISFFISAIFHELCIGIPCHIFKFWAFIGIMFQVPLVILTKYLQNKFKSAMVGNMIFWFFFSIYGQPMCVLLYYHDVMNRKVGTE

SEQ ID NO: 212 - protein, 74 aa, Glycine max
MADIDRSFDNNVSAVSTEKSSQVSDVEFSEAEEILIAMVYNLVGERWSLIAGRIPGRTAEEIEKYWTSRFSTSQ

SEQ ID NO: 213 - protein, 146 aa, Arabidopsis thaliana
MGSLQMQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 214 - protein, 268 aa, Arabidopsis thaliana
MGRGKIEIKRIENANSRQVTFSKRRSGLLKKARELSVLCDAEVAVIVFSKSGKLFEYSSTGMKQTLSRYGNHQSSSASKAEEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 215 - protein, 437 aa, Arabidopsis thaliana
MEFESVFKMHYPYLAAVIYDDSSTLKDFHPSLTDDFSCVHNVHHKPSMPHTYEIPSKETIRGITPSPCTEAFGACFHGTSNDHVFFGMAYTTPPTIEPNVSHVSHDNTMWENDQNQGFIFGTESTLNQAMADSNQFNMPKPLLSANEDTIMNRRQNNQVMIKTEQIKKKNKRFQMRRICKPTKKASIIKGQWTPEEDKLLVQLVDLHGTKKWSQIAKMLQGRVGKQCRERWHNHLRPDIKKDGWTEEEDIILIKAHKEIGNRWAEIARKLPGRTENTIKNHWNATKRRQHSRRTKGKDEISLSLGSNTLQNYIRSVTYNDDPFMTANANANIGPRNMRGKGKNVMVAVSEYDEGECKYIVDGVNNLGLEDGRIKMPSLAAMSASGSASTSGSASGSGSGVTMEIDEPMTDSWMVMHGCDEVMMNEIALLEMIAHGRL

SEQ ID NO: 216 - protein, 359 aa, Arabidopsis thaliana
MYHQNLISSTPNQNSNPHDWDIQNPLFSIHPSAEIPSKYPFMGITSCPNTNVFEEFQYKITNDQNFPTTYNTPFPVISEGISYNMHDVQENTMCGYTAHNQGLIIGCHEPVLVHAVVESQQFNVPQSEDINLVSQSERVTEDKVMFKTDHKKKDIIGKGQWTPTEDELLVRMVKSKGTKNWTSIAKMFQGRVGKQCRERWRNHLRPNIKKNDWSEEEDQILIEVHKIVGNKWTEIAKRLPGRSENIVKNHWNATKRRLHSVRTKRSDAFSPRNNALENYIRSITINNNALMNREVDSITANSEIDSTRCENIVDEVMNLNLHATTSVYVPEQAVLTWGYDFTKCYEPMDDTWMLMNGWN

SEQ ID NO: 217 - protein, 386 aa, Arabidopsis thaliana
MSKRPPPDPVAVLRGHRHSVMDVSFHPSKSLLFTGSADGELRIWDTIQHRAVSSAWAHSRANGVLAVAASPWLGEDKIISQGRDGTVKCWDIEDGGLSRDPLLILETCAYHFCKFSLVKKPKNSLQEAESHSRGCDEQDGGDTCNVQIADDSERSEEDSGLLQDKDHAEGTTFVAVVGEQPTEVEIWDLNTGDKIIQLPQSSPDESPNASTKGRGMCMAVQLFCPPESQGFLHVLAGYEDGSILLWDIRNAKIPLTSVKFHSEPVLSLSVASSCDGGISGGADDKIVMYNLNHSTGSCTIRKEITLERPGVSGTSIRVDGKIAATAGWDHRIRVYNYRKGNALAILKYHRATCNAVSYSPDCELMASASEDATVALWKLYPPHKSL

SEQ ID NO: 218 - protein, 292 aa, Arabidopsis thaliana
MEPPQHQHHHHQADQESGNNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQEEEECGGDAYLEHRRTLPLFPMHGEDHINGGSGAIWKYGQSEVRPCASLELRLN

SEQ ID NO: 219 - protein, 453 aa, Brassica napus
MDLGSVTGNVNGSPSLKELRESKQDRSEFDGEDCLQQSSKLARTIAEDKHLPSSYAAAYSRPMSFHQGIPLARSASLLSSDSRRQEHMLSFSDKPEAFDFSKYVGLDNNKNSLSPFLHQLPPPYCRTPGGGYGSGGMMMSMQGKGPFTLTQWAELEQQALIYKYITANVPVPSSLLISIQKSFYPYRSFPPSSFGWGTFHLGFAGGKMDPEPGRCRRTDGKKWRCSKDAVPDQKYCERHINRGRHRSRKPVEVQPGQTAASKAAAVASRNTASQIPNNRVQNVIYPSTVNLPPKEQRNNNNSSFGFGHVTSPSLLTSSYLDFSSNQNKPEELKSDWTQLSMSIPVASSSPSSTAQDKTTLSPLRLDLPIQSQQETLEAVRKVNTWIPISWGNSLGGPLGEVLNSTTSSPTLGSSPTGVLQKSTFCSLSNSSSVTSPVADNNRNNNVDYFHYTT

SEQ ID NO: 220 - protein, 461 aa, Brassica napus
MDLGSVTGNVNGSPGLKELRGSKQDRSGFDGEDCLQQSSKLARTIAEDKHLPSSYAAYSRPMSFHQGIPLTRSASLLSSDSRRQEHMLSFSDKPEAFDFSKYVGLDNNKNSLSPFLHQLPPPYCRSSGGGYGSGGMMMSMQGKGPFTLTQWAELEQQALIYKYITANVPVPSSLLISIQKSFYPYRSFPPSSFGWGTFHLGFAGGKMDPEPGRCRRTDGKKWRCSKDAVPEQKYCERHINRGRHRSRKPVEVQPGQTAASKAVASRDTASQIPSNRVQNVIYPSNVNLQPKEQRNNDNSPFGFGHVTSSSLLTSSYLDFSSNQEKPSGNHHNQSSWPEELKSDWTQLSMSIPVASSSPSSTAQDKTALSPLRLDLPIQSQQETLESARKVNTWIPISWGNSLGGPLGEVLNSTTSSPTLGSSPTGVLQKSTFCSLSNSSSVTSPIADNNRNNNVDYFHYTT

SEQ ID NO: 221 - protein, 409 aa, Arabidopsis thaliana
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 222 - DNA, 685 bp, Nicotiana benthamiana
aaagtccactggaagaatactcttcaacagttggaaagagttggacctaagtcggttggtgtctgtctgttaacagcagcttttgttggcatggccttcactatccaatttgttagagaattcactagattagggttaaatagatctgttggtggggtgttggcccttgccttttcaagagagctaagtccagttgtcacatcaattgtagttgctgggcgtatcggtagtgcatttgctgcggaactgggcactatgcaggtatctgagcagactgacacgttgagagttcttggtgcaaatcctgttgattatttggtgacaccaagagtgattgcttcttgcgttgcattaccatttttaaccctaatgtgctttacagttggaatggcatccagcgcccttttggcagatggtgtttatggaattagcataaacataatcttagattctgctctgagagctcttagatcatgggaccttattagtgcaatgattaaatcaggggtgtttggtgctattatatccatcataagctgtgcttggggggtcaccacgctgggaggtgccaaaggggttggagagtcgactacttcagcagtagttttatctcttgttggcatattcatagctgactttgctctctcttgctgtttcttccagggtgctggcgattccctgaaga

SEQ ID NO: 223 - protein, 824 aa, Solanum tuberosum
MDISNEAKVEFISIGPSSIVGRTIAFRVLFCKSISRLRHNIFHFLIYYLYKIKNCLSYYLTPLIKWFHPRNPQGILALVTLLAFLLRRYTNVKIRADMVYKRKFWRNMMKSALTYEEWAHAAKMLEKETPKMNEAEFYDEELVVNKLQELQHRRNEGSLRDIMFFMRADLVRNLGNMCNPQLHKGRLHVPKLIKEYIDEVSTQLKMVCDYDSDEILLEEKLAFMHETRHAFGRTALLLSGGASLGAFHVGVVKTLVEHKLMPRIIAGSSVGSIMCSVVATRSWPELQSFFENFWHVLQPFEQMGGILTVFRRIMRQGAVHEIRQLQVMLRHLTNNLTFQEAYDMTGRVLGITVCSPRKHEPPRCLNYLTSPHVVIWSAVTASCAFPGLFEAQELMAKDRSGNLVPYHPPFHLEPDQAAASGSSARRWRDGSLEIDLPMMQLKELFNVNHFIVSQANPHIAPLLRIKEFVRAYGGNFAAKLAHLTEMEVKHRCNQVLELGFPLRGLAKLFAQDWEGDVTVVMPATLAQYLKIIQNPSTLEVQKAANQGRRCTWEKLSAIKANCGIELALDECVAILNHMRRLKRSAERAAAASQGMSSSTVKLNASRRIPSWNCIARENSTGSLEEDFHADASSSLHHHNAGRNWRCNNKNAAHDHHGSDSESENADNNSWTRSGGPLMRTTSADKFIDYVQNLEMHPSQRSSRGLSIDLNNVVVREPLSPSPRVTTPARRSDTEFDQRDIRIIVAEGDLLQTERTNNGIVFNVVRRGDLTPSNRSLDSENNSCFHDPVAECVQLENPEKDMDISSASEDGENAVLDEVTKNQII

SEQ ID NO: 224 - DNA, 2475 bp, Solanum tuberosum
atggatataagtaatgaggctaaagtagagttcatttccataggaccttcttcaattgtaggtcgaacaatagcctttcgagttttgttttgcaaatcaatatcgcggttgaggcacaacatttttcatttcttgatatattacttgtacaagatcaagaattgtctgtcatactacttgacacctttgatcaaatggtttcacccgcgtaatccacaggggatattagcattagtaacacttctagccttcttgttgaggcgatatacgaatgtaaaaatcagggctgatatggtttataagaggaaattttggaggaatatgatgaaatctgcattaacttatgaggaatgggctcatgctgcgaaaatgttggagaaagagacacctaaaatgaatgaagcagagttttatgatgaagagttagttgtaaataaacttcaagaacttcaacatcgtcgtaatgaaggatctttaagagatattatgttctttatgagagctgatcttgtgagaaatctgggtaatatgtgtaatccacagcttcataagggtaggcttcatgtgcctaaacttattaaggagtatattgatgaggtttcaactcagttgaaaatggtatgtgattatgattcagatgagattttgttggaggagaagcttgcttttatgcatgaaacaagacatgcttttggtaggacagcattgcttttaagcgggggcgcgtctttgggagcttttcatgttggtgtggttaagacattggttgagcacaagcttatgccaaggataattgctggttcgagtgttggatcgattatgtgttctgtagttgcaactcggtcttggcctgagctgcagagtttttttgagaatttttggcatgtgttgcagccgtttgaacagatgggtggaattctaactgttttcaggaggatcatgagacaaggggctgtacatgagattaggcagttgcaggtgatgttacgccatctcacgaataatcttactttccaagaagcttacgatatgactggtcgagttctagggattactgtttgctcccctagaaaacatgaacctcctagatgtttgaactacttgacttcacctcatgttgttatatggagtgctgtgactgcttcttgcgcgtttcctggtctgtttgaagctcaagaactgatggcaaaggatagaagtggtaatcttgttccttatcatccaccatttcatttggaacctgatcaggctgcagcttctggttcatctgctcgtcgatggagggatggtagcttggagatcgatctacctatgatgcagctaaaagagctattcaacgtaaaccactttatcgtgagccaggcgaatccacatattgctcctttactcaggatcaaagagtttgtaagagcttatggaggcaactttgctgccaagcttgctcatcttactgagatggaagtgaagcacagatgcaatcaggtactggaacttggttttcccttgaggggattagccaagctatttgctcaagattgggaaggcgatgtcaccgttgtaatgccagccactcttgctcagtacttgaagatcatacagaatccctctactttggaggttcaaaaagcagcaaatcaagggaggagatgcacttgggagaaactatcagccattaaggcaaattgtggaattgagcttgctcttgatgagtgtgtagcaatactcaaccatatgcgtagactaaaaaggagcgcggagagagcagctgctgcttcacaaggcatgtcaagcagcacagtcaaactcaatgcttctagacgtattccttcttggaattgcattgcaagagagaactcaacaggctcccttgaagaagactttcacgcggatgcttcttcctctcttcatcatcacaatgctggtcgaaactggcgttgtaataacaagaatgctgcacatgatcatcatggtagtgacagtgagtctgaaaacgcggataataattcttggacaagatcaggtggtccattgatgaggacaacatcagctgataagtttattgactatgtacaaaacttggaaatgcatccttcacaacgatcgagcagaggactgagtattgacctcaacaatgttgtagtcagggagcctctttctccgagtccacgagtgacaacacctgctaggagatcagatacagaatttgatcaaagagacatcagaattatcgtcgctgaaggtgatttactacagactgaaaggactaacaatgggattgtattcaatgtggtaaggagaggagacttaactccatcaaacaggagtcttgattcagaaaacaacagttgctttcatgatccagtggccgaatgcgtgcaactcgaaaatcctgagaaggatatggatataagttcagcatcagaagatggagaaaatgcagtactagatgaagtaacaaaaaatcagatcatataa

SEQ ID NO: 225 - protein, 521 aa, Solanum tuberosum
MAASIGALKSSPSSNNCINERRNDSTRAVSSRNLSFSSSHLAGDKLMPISSLRSQGVRFNVRRSSLIVPPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLSLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKSCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 226 - DNA, 1819 bp, Solanum tuberosum
ctagtgattgcaatcacactctaccacacactctctagtagagagatcagttgataacaagctttgttaacaatggcggcttccattggagccttaaaatcttcaccttcttctaacaattgcatcaatgagagaagaaatgattctacacgtgcagtatccagcagaaatctctcattttcgtcttctcatctcgccggagacaagttgatgcctatatcgtccttacgttcccaaggagtccgattcaatgtgagaagaagttcattgattgtgccgcctaaggctgtttctgattcgcagaattcacagacatgtctagacccagatgctagccggagtgttttgggaattattcttggaggtggagctgggacccgactttatcctctaactaaaaaaagagcaaagccagctgttccacttggagcaaattatcgtctgattgacattcctgtaagcaactgcttgaacagtaacatatccaagatctatgttctcacacaattcaactctgcctctctgaatcgccacctttcacgagcatatgctagcaacatgggaggatacaaaaacgagggctttgtggaagttcttgctgctcaacaaagtccagagaaccccgattggttccagggcacggctgatgctgtcagacaatatctgtggttgtttgaggagcatactgttcttgaataccttatacttgctggagatcatctgtatcgaatggattatgaaaagtttattcaagcccacagagaaacagatgctgatattaccgttgccgcactgccaatggacgagaagcgtgccactgcattcggtctcatgaagattgacgaagaaggacgcattattgaatttgcagagaaaccgcaaggagagcaattgcaagcaatgaaagtggatactaccattttaggtcttgatgacaagagagctaaagaaatgcctttcattgccagtatgggtatatatgtcattagcaaagacgtgatgttaagcctacttcgtgacaagttccctggggccaatgattttggtagtgaagttattcctggtgcaacttcacttgggatgagagtgcaagcttatttatatgatgggtactgggaagatattggtaccattgaagctttctacaatgccaatttgggcattacaaaaaagccggtgccagattttagcttttacgaccgatcagccccaatctacacccaacctcgatatctaccaccatcaaaaatgcttgatgctgatgtcacagatagtgtcattggtgaaggttgtgtgatcaagagctgtaagattcatcattccgtggttggactcagatcatgcatatcagagggagcaattatagaagactcacttttgatgggggcagattactatgagactgatgctgacaggaagttgctggctgcaaagggcagtgtcccaattggcatcggcaagaattgtcacattaaaagagccattatcgacaagaatgcccgtataggggacaatgtgaagatcattaacaaagacaacgttcaagaagcggctagggaaacagatggatacttcatcaagagtgggattgtcaccgtcatcaaggatgctttgattccaagtggaatcatcatctgaaggaatgcgttttaacttggttgtcctccaagattttggctaaacagccatgaggtagaaacgtgctgaacttttattttcctgagctgtagaaatctagtgtacatctttctgttatgatacttctcattacccctacaagagaagactggatgctgtaaaaattattcgtctagaataa

SEQ ID NO: 227 - DNA, 1173 bp, Sapium sebiferum L.
tgccaatagccagccaataaaacatctacacgttttcacacggcttttcatcacagccgttgtttttctcatctcactccgtgccttcatcttcatcctcttctcctctctctctgtctctatatgtatagaagcgttagatgtcttgcgttgttaaccaattcatttttcgctttctgcttcttctaatattataagaaagtttgattcttcttcttgtcaatctttgttcgcggcttttaacgatatccgctaaaggaaatttgaaatttcaattatggccgatggaaacgtcaattcgcaagaacagatggctaagcaggaggaacagaggctgaagtatttggagtttgtacaagtggctgcaatacatgctgtggtgaccttcacaaacctctatgtttatgccaaaaacaagtcgggtccattgaagcccggtgttgagactgttgaaggtacggtcaagagtgtggttggacctgtttatggcaagttccatgatgttcccattgaggttctcaagtttgtcgatcgcaagattgatcaatctgtaagcagcctagacagccgtgtgcctccagttgtgaagcagttatcggcccaagcattttcagtggctcgcgaagccccagtggctgctcgtgctgtggcttctgaagtgcagactgctggagtgaaggaaactgcatctgggttggcaagaactctgtacttcaaatatgaacccaaggccaaggagctatacaccaagtatgaaccaaaagcggaacagtgtgctgcctctgcctggcgtaagctcaatcaactcccagtcttccctcatgtagctcaggttgttatgccaacagcagcttattgttctgaaaagtacaaccaggcagtacttaccaccgctgagaaaggatacagagtgtcctcttatttgccttttgtgcccactgagagaattgctaagttgtttaggaatgaggcacctgaatctacccctttcctttccaattgagcaagatgctgataaatgattcacaatggacatgtggacagaataaaaatctttggatattatatggtactgtgtatttcaaggttcaagattactctctacaatgtgtgaatttttgtttcagatgacttaattcttgttcattcattatatatatatatatatatata

SEQ ID NO: 228 - protein, 241 aa, Sapium sebiferum L.
MADGNVNSQEQMAKQEEQRLKYLEFVQVAAIHAVVTFTNLYVYAKNKSGPLKPGVETVEGTVKSVVGPVYGKFHDVPIEVLKFVDRKIDQSVSSLDSRVPPVVKQLSAQAFSVAREAPVAARAVASEVQTAGVKETASGLARTLYFKYEPKAKELYTKYEPKAEQCAASAWRKLNQLPVFPHVAQVVMPTAAYCSEKYNQAVLTTAEKGYRVSSYLPFVPTERIAKLFRNEAPESTPFLSN

SEQ ID NO: 229 - DNA, 1252 bp, Sapium sebiferum L.
ctacttttccctagcattagtattctaggccccactctgtagattcctccagctgcctgatctaattttttatcaactcttgaccgttcgatcatcccaacggctcagattcactagtacttttctcacaccgtatctccgattctccatgactccatcgatataaatcgcagtgctcatcaactgaattctcgaaattgcggttacaagctgctataagaagcgaaaagaaacgctgagaaacaggatccgttcctcctccctcgttttttactccttacaagatggagaccgagaagaagattcctgaattgaagcacttagggttcgtgaggatggctgctattcagtcactgatttgcgtctcgaatctctacgattacgcgaagcataactcaggacctttgagatccactgttggaaccgtggagggtgccgtaaccaccgtagtaggtccagtttaccagaaattcaaagaccttcctgatgatcttcttgtatatgttgataagaaggtggatgaaggaacacacaagtttgataagcatgctccacctattgctaagaaggctgcgagccaagcccatagtttgtttcatatagccttggagaaggtcgaaaaactcgtgcaggaggctcgtgcaggaggacctcgtgctgctctgcattttgtggctacagagtcgaagcacttggcgttgacccaatctgtgaagctgtatagtaaacttaatcagttccctgtcattcacactgttacagatgtaacccttcccacagctactcactggtcagataagtataaccatacccttatggacctgacccggaagggttatacgatctttggttatttgcctttggttcctattgatgacatatctaagacatttaaacaaagtaaagcagaggagaaagaaaatgcaactacgcataaatctgattcatcggattccgactaaacggttgccatcatgtctaatgggtgtggtttgttaagtatagtggtttgcgaaaatgttctagggtttatgagcctgctcgaaagatgctgagaaatggaaatctgtactatttaggagtttttccgtactataataatgagtatgaatggtttgtaaattctgccttgtgctttctcgacaagtatatcatgcttctattttttactactacttactggactactgaattgtctcataattgtccctagtgtctaattaaatatcacctccaaaatattattgaaaaa

SEQ ID NO: 230 - protein, 225 aa, Sapium sebiferum L.
METEKKIPELKHLGFVRMAAIQSLICVSNLYDYAKHNSGPLRSTVGTVEGAVTTVVGPVYQKFKDLPDDLLVYVDKKVDEGTHKFDKHAPPIAKKAASQAHSLFHIALEKVEKLVQEARAGGPRAALHFVATESKHLALTQSVKLYSKLNQFPVIHTVTDVTLPTATHWSDKYNHTLMDLTRKGYTIFGYLPLVPIDDISKTFKQSKAEEKENATTHKSDSSDSD

SEQ ID NO: 231 - DNA, 938 bp, Sapium sebiferum L.
gagtattcacactctggcctgattgggtttgctataaagggcgatcgttgcaacgctccatattgtctacttggttttgtttcaaatctcatcattttgtaaatttgcgacagtgtagcgttttctaggaaaaaggttgctaaaggaaagtagttatcaaaccgcagaaatggcggaatccgaacttaatcaacacacagatatggttcaagatgatgataaaaaactcaagtatctagattttgtacaagtggccgcgatctatgttgtggtttgtttctctagtatctatgaatatgctaaggaaaactccggtccactaaaaccaggggtccaagccgttgagtgtaccgtcaaaactgtaataagtccggtttacgagaagtttcgcgacgtaccttttgaactccttaaattcgtcgatcgtaaagttgacaactctctaggcgagttggacaggcacgtgccgtcgctggtgaagcaggcatcaagccaagctcgagctgtggctagtgaaattcaacatgctggattggtagacgcaactaagaacattgcgaagacgatgtatacaaagtatgaactgacggcttggcagctctactgcaaatacaagccggtggctaagcgttacgcggtgtcgacctggcgctcattgaaccagcttcctctgtttcctcaagcggctcagattgcaatcccaactgctgcttcgtggtctgagaaatacaataagatggttcgttacacgaaagatagaggatatccagcggcggtgtatctgccattgatctcggttgagaggattgccaaggtgttcaatgaagacttaaacgggcccaccgtccctaccaatggatcatccgccgcagcacaatagttttcattttatgtatttatgtcagattgaagacgctccggagattttgaaaacctga

SEQ ID NO: 232 - protein, 194 aa, Sapium sebiferum L.
MAESELNQHTDMVQDDDKKLKYLDFVQVAAIYVVVCFSSIYEYAKENSGPLKPGVQAVECTVKTVISPVYEKFRDVPFELLKFVDRKVDNSLGELDRHVPSLVKQASSQARAVASEIQHAGLVDATKNIAKTMYTKYELTAWQLYCKYKPVAKRYAVSTWRSLNQLPLFPQAAQIAIPTAASWSEKYNKMVRYT

SEQ ID NO: 233 - DNA, 2526 bp, Sorghum bicolor
atggacgagtccggggaagcgagcgtcggctccttcaggatcggcccgtcgacgctgctgggccgcggggtggcgctccgcgtgcttctcttcagctcgctgtggcgcctgcgggcgcgcgcgtacgccgccatctcgcgcgtgcgcagcgcggtgctgccggtggcggcgtcctggcttcacctcaggaacacccacggcgtcctcctcatggtcgtcctcttcgccctctccctgaggaagctctccggcgcgcggtcgcgggcggcgctcgcgcgccggcgcaggcagtacgagaaggccatgctgcatgccgggacgtacgaggtctgggcccgcgccgccaatgtgctcgacaagatgtctgatcaggtccatgaggcggatttctatgacgaggagctgatcaggaacaggcttgaggacctccggaggcggagggaggacgggtcgctgcgggacgtggtgttctgtatgcgcggcgatcttgttaggaacttggggaacatgtgcaatcctgaacttcacaagggcaggctagaggttcctaagcttataaaggaatacattgaagaggtttctattcaactaagaatggtgtgcgaatctgacactgatgagttgctattgggagagaagcttgcctttgttcaggagaccaggcatgcctttgggaggacagccctactcttaagtgggggtgcttcactggggtctttccatgtaggtgtagtgaaaacattggttgagcataagcttctgcctcggattatagcaggatcaagcgttggttccattatatgttcgattgttgctacccggacatggcctgagattgagagcttcttcacagactcattacagaccttgcagttctttgataggatgggtggaatttttgcagtgatgaggcgagtcaccactcatggtgcactgcatgacattagccagatgcaaaggcttctgagggatctcacaagtaacttaacatttcaagaggcttatgacatgactggccgtgtccttgggatcaccgtttgctctcctagaaaaaatgagccaccccgctgcctcaactatctgacgtcgccgcacgttgttatttggagtgctgtaactgcctcttgtgcatttcctgggctctttgaagctcaggaactgatggcgaaggatagattcggcaacatagttcccttccatgcaccctttgccacagatcctgaacaaggtcctggagcatcaaagcgccggtggagagatgggagcctggaaatggatttgcccatgatgagactcaaggagttgtttaatgtaaaccatttcattgtgagccaaactaatcctcacatttctcccctcctccgaatgaaagagcttgttagagtctatggagggcgctttgctggaaagcttgctcgtcttgctgagatggaggttaagtatcgatgtaaccaaatcctagagattggtcttccaatgggaggacttgcaaaattgtttgctcaggactgggagggtgatgtcaccatggttatgccggcaacagtagctcagtatttgaagattattcagaatccaacatatgcggagctccaaatggctgccaaccaaggccgcaggtgtacatgggagaagctctctgcaatcagagcaaactgtgccatcgaacttgcattggatgaatctatagcagttttaaaccacaaacggaggctaaaaagaagcatggagaggacagaggctgctttgcagggtcattctaactatgttcgactcaaaactccaaggagggtaccatcatggagctgcatcagtcgagagaattcttcagaatctctctcggaagagatttcagcagttgctacttcaaccgcgcagcaaggtgctgctcttgttgtcggcacagccactctttctcaccatgttcgacgcaattctcatgacggaagtgagagtgaatcagaaaccattgaccttaattcctggaccaggagtggtgggcctctaatgaggacagcatctgctgacatgttcatcagtttcatccataaccttgagattgacacggaattaagtaggccctgtactgtggagggtggtactgcaggtatttcgtcagaatctaccttcccaaatgatccacaaccgaacaatggctcaagtgttactactccaggtagatgcacagaaaattctgagaccgaggcatacgacactgtcaacaccagagccagtcaggcttctactcccacaagcatcgctgtttctgaaggagatttgctgcagcctgaaagcattgctgacggtatcctgcttaacattgtgaaaagagatgccttgcaggctcaaaatgacagcgtaactgaattggccgaaagctcctgcactgaaacatatgcggaaacttgtgacaccatctcagggtctggcactgctgaagataacaaggatactgctgactcaagcaatcactcacttgatattgatgcttttgtagtttcgcatcaaccttcagctgatgattag

SEQ ID NO: 234 - DNA, 3099 bp, Triticum aestivum
atgcccgcgcctgcaggtgcgtgcagccaagccccaccgctcgccttctattccgcgtcccctagcttggcccggccctgctccgatccaaggccgcggcggtggcccagtgccctctccctcctgccacgccgtccgccgcccatggacgtcatcaccaacgaggcgcgcgtgggggcgttcgcgatcggcccgtccacggcggcggggcgcgcgctcgcgctgcgcgtgctcctctgcggctcgctggcgcggctgcggcaccgcctcgccgccgcgctgcgcgccgcggcgccgctggcggcggcctggctgcacccgcgccacaacacgcgggggatcctgctcgccgtctgcgccgtcgcgctgctgctgcgcggccgcgggggccgcgccggggtgcgcgcgcgggtgcagtccgcctaccgccgcaagttctggcggaacatgatgcgcgccgcgctcacctacgaggagtgggcgcacgccgcgcggatgctcgagcgggagacgccgcgccgcgtcaccgacgccgacctctacgacgaggagctcgtgtgcaacaagctccgtgagctcaggcaccgccgtcaggagggctcgctcagggacatcgtcttctgcatgcgcgccgatctgctcaggaaccttggtaacatgtgcaaccccgagctccacaagttgaggctgcaggtgcctaaaaccatcaaggagtacattgaggaggtatctactcaactgaaaatggtttgcaattctgattcggacgagttaccccttgaagagaaactggcatttatgcatgagacaagacatgcctttggtagatcggccctactgctaagtggaggtgcttcatttggctctttccatgtgggtgttgtgaaaaccttggtagagcataagcttctacctaggattatttcaggatcaagcgttggcgcaataatgtgtgctattgtagccacacggtcatggccagaactagagagtttttttgaggagtggcattccttgaaattctttgaccagatgggtgggatctttcctgtatttaaaagaattttgacgcatggagcggttcatgacattaggcacttgcagacgcagttgagaaatcttacaagcaatttgacatttcaagaggcatatgacatgactggccgggttctcgttgttactgtgtgttctccaagaaaacatgagccaccacgatgcctgaactatttgacatcacctcatgttctcatttggagtgcagtaactgcttcctgtgcttttcctggactttttgaggcccaggagttgatggccaaagatagattcggagaaacagttccttttcatgctccattcttgttgggtgtggaggaacgagctgacgctgctacacggcgctggagagatggcagcttagaaagtgatttacccatgaagcaattgaaggaattattcaacgtaaatcacttcatagtaagccaagccaatcctcacattgctccattactgagactaaaggagatcatcagggcttacggaggcagctttgctgcaaagcttgctgaacttgctgagatggaagttaagcataggttcaatcaagttctggaacttggatttccattaggaggaatagctaagttgtttgctcaacattgggaaggtgatgtgacaatcgttatgccagccacacttgctcagtattcgaagatcatacagaatccttcgtattctgagcttcagaaagccgcaagtcagggtaggcgatgcacttgggaaaagctctctgctatcagggcaaactgcgctattgagcttgcattagatgaatgtgttgccctcctgaaccacatgcgtaggctgaagagaagtgcagaaagagcagctgcttcacaaggatatggtgctacaattagactctgtccatctagaaggattccatcatggaatctcatagcaagagaaaattcaactggttctctcgatgaggaaatgctcacatgtcccactgttacgagccatcaagcagttggagggactgctgggccatctaacagaaatcaccatctccaacatagtatgcatgatagcagtgacagtgaatctgagagtatagacttgaactcatggacgagaagtggtggccctctcatgagaacagcctcagctaataaattcatcagctttgttcagaaccttgagattgacacagaattcagaacaatttcaccaagggggagcgaaggtgatattgttacaccgaatagtaacttatttgctggtcacccaattggtagagagccagttgataaccatccagggcctgctactcctggtaggacctcaggcaattcaggttgcgatcctcatgatactcctgttcctaggtctccatttggtctttccacaagtatcatggtccctgaaggtgacttgctgcagccggaaaagattgagaatggtattttattcaatgttgtgagaagggatgctcttgtagcgactactagcggagttgaacctcatggatcttcacaggaagcagatgtggaaactgtaccgaccgagtgcctttatggtgcttcggatgacgacgacgacaacgtggaactgaatgctgatcatgaagcattatctgaccctggagatcagagatcctcagttgcaggaaacctagatccgtccacttccatggattgtcaagctgatgaaacaagtactactcgatcagaagctccatctctctttaatatctgtgtggagattcctccagcaaccatgatcagagaaaatagtcggcccgacgagccttcttcagacataagactggagattgtaaagacagaatgccctgatgagaattcagctgctgggaacgatgaagttggctcagttcctgccaataaagaatcttcctattgttctcagacagctgaaaatagacagcagcatcaagttgatatgggatctgtgaactcctgtagtgtttcagtttcagaagatgataggcatgtcagcctcatttcgaacgagaaaccagttactacttccagtggcggagcggagagtatgacatctggaagaaatgaagctgactag

SEQ ID NO: 235 - DNA, 2198 bp, Artificial Sequence
  S. bicolor SDP1 hpRNAi fragment
gcggcggcgtggctgcacccgcgcgacaacacgcgcgggatcctgctcgccgtctgcgccgtcgcgctgggtgcagtccgcctaccgccgcaagttctggcggaacatgatgcgcgccgcgctcacctacgaggagtgggcgcacgcggcgcggatgcttggagtgcagtaacagcttcctgtgcttttcctggactttttgaggcccaccatctaggaggattccatcctggaatctcatagcaagagaaaattcaactggttctctatgtgcaatcctgaacttcacaagggcaggctagaggttcctaagcttataaaggaatacattgaagaggtttctattcaactaagaatggtgtgcgaatctgacactgatgagttgctattgggagagaagcttgcctttgttcaggagaccaggcatgcctttgggaggacagccctactcttaagtgggggtgcttcactggggtctttccatgtaggtgtagtgaaaacattggttgagcataagcttctgcctcggattatagcaggatcaagaagggtggacccagctttcttgtacaaagtggtctcgaggaattcggtaccccagcttggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcattttatatagtattattttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaagctgggttcgaaatcgataagcttgcgctgcagttatcatcatcatcatagacacacgaaataaagtaatcagattatcagttaaagctatgtaatatttgcgccataaccaatcaattaaaaaatagatcagtttaaagaaagatcaaagctcaaaaaaataaaaagagaaaagggtcctaaccaagaaaatgaaggagaaaaactagaaatttacctgcacaagcttggatcctctagaccactttgtacaagaaagctgggtccacccttcttgatcctgctataatccgaggcagaagcttatgctcaaccaatgttttcactacacctacatggaaagaccccagtgaagcacccccacttaagagtagggctgtcctcccaaaggcatgcctggtctcctgaacaaaggcaagcttctctcccaatagcaactcatcagtgtcagattcgcacaccattcttagttgaatagaaacctcttcaatgtattcctttataagcttaggaacctctagcctgcccttgtgaagttcaggattgcacatagagaaccagttgaattttctcttgctatgagattccaggatggaatcctcctagatggtgggcctcaaaaagtccaggaaaagcacaggaagctgttactgcactccaagcatccgcgccgcgtgcgcccactcctcgtaggtgagcgcggcgcgcatcatgttccgccagaacttgcggcggtaggcggactgcacccagcgcgacggcgcagacggcgagcaggatcccgcgcgtgttgtcgcgcgggtgcagccacgccgccgc

SEQ ID NO: 236 - DNA, 22 bp, Artificial
  Oligonucleotide primer
ttttaacgatatccgctaaagg

SEQ ID NO: 237 - DNA, 23 bp, Artificial
  Oligonucleotide primer
aatgaatgaacaagaattaagtc

SEQ ID NO: 238 - DNA, 22 bp, Artificial
  Oligonucleotide primer
cttttctcacaccgtatctccg

SEQ ID NO: 239 - DNA, 25 bp, Artificial
  Oligonucleotide primer
agcatgatatacttgtcgagaaagc

SEQ ID NO: 240 - DNA, 18 bp, Artificial
  Oligonucleotide primer
gcgacagtgtagcgtttt

SEQ ID NO: 241 - DNA, 25 bp, Artificial
  Oligonucleotide primer
atacataaaatgaaaactattgtgc

SEQ ID NO: 242 - DNA, 23 bp, Artificial
  Oligonucleotide primer
acagacatgtctagacccagatg

SEQ ID NO: 243 - DNA, 24 bp, Artificial
  Oligonucleotide primer
cactctcatcccaagtgaagttgc

SEQ ID NO: 244 - DNA, 25 bp, Artificial
  Oligonucleotide primer
ctgagatggaagtgaagcacagatg

SEQ ID NO: 245 - DNA, 21 bp, Artificial
  Oligonucleotide primer
ccattgttagtcctttcagtc

SEQ ID NO: 246 - DNA, 2631 bp, Saccharum hybrid
ctgcgacagctagaggcgccaccgcgtcctagcttcctccaacttctcgtcggagatcccttcagggatgcccaatgccaccgcccctaagtcaacctgcgggagctggagcttcgccagggtcagagctgcggcagcaccctggtagaccgcattcctgatgacccgcggggtgcgctccatgaagaagtgcattcgcccaaccaagtcgagtgggtcgcctggagggggcggggaagcaaaacgttgcatgcacctagcgccctggcagcgagctcctgtagtatcacctgcgtcgcctccagctcatgctcgcaagcctccagggcggcccggcagtgctccaacactttcgcctcctcctacagctccttccacatgcagtcgtgctccgcacgcaccttctccacctttttactcttttctttctcttttcttggcccatctttggtattttcacaaatgtccccctacaaatgataaatcaccaaaactcatggagcttgctagttataaactctaattctaagtttggtgtttatttgagtggattttgtgtgaaagttggtggttagaaataggagttaaggaccgccaacaagatcccccacacttagccctttgctcatcctcgagtaaagttcaaggactaaggtggaacatctcctcaaatggtacgatgcctgcatataagttattccaagcctcacctatacatgtgaactttgaagtgtctaccacgccatcttgggtggttgagaaatggaacagatcagaatccagtcatctttacctctcttgcttagataacttgggtttttgtaaggttttcaaatttaaaacatagtcttgctcctcaaatgattctctcatatagctcaatgtgtatggtttctcaccaaggcaatgttttgcctcttttcatcctacttctaatatttcttttgtggagcttagggtagggaatgaaaaggaagcatacttgcattgcatatgttactaagtcaaaaaccaaatctgaggagaagcaagtcatacaatctgatcaagatgtgcaagtgtgtggatatgtggattaagataactcctgtttattcatgctctcctccttaataaactttagagggcatggcaatctttgcatgggccttcatgagctcatcgtatgtctaagcatggagctcatcatttatataagcatggtgataccaaaattactccttttgagcatgtttatatttaggaggacgttttacctgttgaggtaaatctgaacgctaataaatcggctaagcaaaataatttatcacctgttgattctaacaatttgatgatggacaatattgatgaggtgactgacaaatgattgaaggctttaaaggagattgagaaggataaatctacaataaaaatgtaaagaagaaagcattcaaagtgtgagatctggtgtggaagactattttgcctcttgggggtaaaagacaacaagtttagtaagtggcctcaaaattgggagggcccatgcaagattgttaaagtaattgttttggattgacggaggcatttcaaggtgatcatctacctagagctctcaatgggaggtgctcgaagacatattacccatgtgtatggcaagatgtttagctagtaactgactgatagtgtaaacgatctccaatggggcaagacatattacctaaggccaggctggtttttgcaagttcgagtaggatatagagattctcgtgcgagttgtaaacgatctccaatggggcaagacatcctaccctatatatagtgaaggggcagtagctgattgagaatcaatcaatcaagcacaatataatttattaattttttattcaaacccaatttttttccttttccaaccctaattatagttttccttttgcctctaggacaaattgacgtgttccgggtatcctgctgaattaagaacaaccctaggtgcacctgtcccgatagagtcccacctgggtaggcattcatagggattcgtgtatttcctgcaaaaaagcgattaagctggcttctaaaactggctaggccggattctgtggccttcactaccaggtgattttcatgtgatccgtgcattctagcactttgctatgtaacccaaacttaagtcgacaactataaatatgctacttgcaggatgttatcacgacacaactcctaatctacggaagcctaagtttagttttgctcggagacaagcaattgtggccagtcactatagctacgtcagagggtagtgggagcagttgcgtcgttggattgaaaacaggtggatcgtatcagatattatgcattcacatggacagtaaatgtggtacagtaacttcgcaaacaataaaatctgtcacaatttattagtgcactcctctgacgtaaatgcttctacgtcagaggatttgattccgagggccgctgcacccatcactaatgacggtctttacccatcatcatggaccattgttcacatccatgctatcactgtcgtcctgtccatgcactgcagccctctataaatactggcatccctcccccgttcacagatcacacaacacaagcaagaaataaacggtagctgccataactagtaca

SEQ ID NO: 247 - DNA, 2907 bp, Saccharum hybrid
gcataggcattgtaaaagcggtatgcctcttcttcagtgcagaatttcataccaaccttaggtatcctgtcttccatagaattttctacctgagtaggttcggtctggttggatttgtagcgggtttcatgcaaaataagttagaaatcgtgcaaacttgcaatggaggttaaatttgaaatatatttgcatagacaaaacaaatatagattatgaatggtaatccaatatgacttgcattttctaactctattgctactgtgccagatgaagaatgttgatctggagaagttttgtgagaatgtgacaacaacgggaggtcatatcaagattctgggtacccgcggagaatcggcctccatgtagttagcctcgtcaggcatggggggaattggctgagatgcccccatgtagtcgtcaggcatggagagtactggctgagatgccattgttgtgtagatcgagagaaacgagaagaatgctagtctaataatacccttccgtatgctaaccaactattataattggcaccatttttcacatgctagcgccttttgcctgctttatttaattcaattgggtccgataagcatgtgaacgtgggagacggttccgtcggacggctccgttttcttgtagcgtacggcgtggacggagaaaaggtgagggcctatctctaaaggggaacgaatggatggtggacacgtgtggggagacaccgaagggacatgccgaggaggcacacaagcttcagcaggcgtctccagactctcagaagaagaagaagctcacggcacggttgcggctggttcttgctgtcgctgtctcgtggtgcacgtttctgtgatcacgctgaaatcgaccggccggcggaccaacaggaggtcagctcggccactccgtctccgagcgcatgagtgcaccgttcgtccgcggttccttttctcgtggtgccgtgcacgcctctgcgttcaccggcaccctgaaaccaatcagaacgttccctttacaggggaaagggacaagtctgataacctctctgtttccatcgtcctctaaccgcgaagagcggacgcacaagacttagagtctatttgttcgaaattttttactctcacaaaagctagcttttatagacgggcataaaagctatcatgtcgaccggcacgtttaatatttaacttataccatatgaatatcatgtcgaactatgaggatgatacttttctgaacgtgattgcgtgagttattaaattgtacttttagttgtttgagcatgaaggtctgaactatgaatttatgatgtattgtggcttgtgagctactccgctctacatttagttggtatcataaatattattatattatcatataaatttgatcaacttgagatgctttgactcttcaagattcttggaatgacttatcatttggggtagggagtaggtttctaaggccagtctcagtggggtttcatcagagtttcatggacattaaataagctgatgtgacaccgtattgatgaagagagagatgataagagtttcatgcgagtagagagagtttcatggggatgaaactcttcttcactgtttccaaaatatagatgcattggtaagagggccatgaaatctctagtgacactgacctaagatgagattgactctagcactatgtttcaaaatctgcatgcatgcatgctttgaatattgtaacctcacattaactcccctcacacatgcatgcaaacgggcggtgcacgcaaaagaattgagtgaagatgcacatgaaaaataagtaaaatgctttggcttcatcacccggcttaaatgctcgacagaaaaacacgtcggtagtcaaggttgtgcctaacaaactggggttcacatgtaaaacacgttcatgccttagaaacggcctggagggattagatacaacttcaattatatcttagggcccctccaatattgtcagctctaaactagttttatgtgtcacggtggaggagagggaggctaaaaatataatcttgagctaacgtgaagagaagagctatttttttttgctccccaatacatgatagatacaatatgagagaaaaaatatatgaataaagaacactttacatgccagccatacaatatgagatttcatctaagagccaacacctgactcgtactgttgaaggtgtcctagttggagtggtcgatcttttagttgttagtagtgtaagacctagtttagtgctcttttcttgtctaggtttatgttgtgttttggctgccaagtgttgaacaactcaaggtaaggtcccatctaattctaaaatgatgccaaataaagatagattacaaagttaaacgacggaaaaactctaaaataggatggaaagttttgtagagtaataattggtatgaagtggcgaagtcgaccacaaccaaacataaagagttaaatgcatggtaggctcttgatcttgtctggaggtgccacttaggtccacaaactctcaaattgcatttttgacaccctaatgttattcaagtgtgccacttagatctacaaactctcaaaatgcatttctgataccctagtgttgttcaagtgtgtcacttaggcaagaaaagttagataattttgataagctatgggaccaaattaatttatgtatgcatgctcgaactagttgatgatgatggaccccataatagacactagttcatgggctggtttccttgtatagtactagctagtataactttttcaagttgtagctactactttagcttatactccgcatattacaatcaaatagaattcggaagtactataaacgggagcctataaatggagacgttttgcatcatgaggctataacaacttgagcaaaaacagaagccgtgcgcc

SEQ ID NO: 248 - DNA, 1141 bp, Saccharum hybrid
actatagggcacgcgtggtcgacggcccgggctggtctggttttggcctcttttagttactaaattgccaaaaagagtgactaaaaagtgactaaactgatttagtcctctagtcaagggactaaaccagctaaaagacatccgctgcccctcattaatgcacagaaggagagagagagggagagggaggacattttggtctttatatagtagctttaatggactttagtacctagatccaaaccggtagtgactaaagtttagtccttgaactgaactttaatccagggacatggaaccaaacatgcccttaacttttttttattctaatccctcttacattcacttgtctcacaaagtggcaagtcatttgccaccctcactaccagtggcgactggttaaatatcctcatgtttggttttttttagtaaccaaatactgcaagctattgggaaaaaaggcaaaaaattatctccttgcttatagttgtataatccatgatccggcaattgtttgttacggagatcctgaatcctctgacgtagagtttaatcaattttagctcaagaataatacactataaagtggatatgacaatcaccgtagtacttatttatcttgtagtagtatactgtattcgacctgcgattatgataaaggcatcagaaactagagtactttctagaatctttagtcagtttctgtaagatgaacgtgactaggaaacttatactgttgcaatcctctgacattctctgattgaaactcggtttccaaaaatcatatgttactaaacaaaacatatctaaccaaatactatgtggtagtgtagatttatatgctgtgtactgaaagtgacgtcaagtatagtagtggcagagactcaaaagatacctgcggattctgaataccacaaccataaaaaacaggatgatgttatacttgtccccttccatgatacaggactgtttagtaatttcccaaacagcccataatacattctgcaccctttattaaacctctactagctacaacatcttactccatcttgtctagttggacaagttctctctttcttggctgactccaacttactacaccgcaacttcttgtgcccttgttccaaccatcacaattgag

SEQ ID NO: 249 - DNA, 4438 bp, Saccharum hybrid
aagtacaaacgtagactctgacatacacgcacgtagactctgacatacacgcataaacgaacgaagaatgttattatttatgttttgagtgggaatatttggtactgctatgattcacgtgtgtaaggaaggattcaagaagaaaggatgcgtttagttcgcgaaaatttttgacttttaccactatagcactttcgtttgtatttgttaattagtgtccaatcatggactaattagactcaaaagatccgtctcgtggttttaaaccaaactgtgtaattaattttttttatctatatttaatgctccatatatgtgtcaaatattcgatataacgaagaatcttgaaaatttttaggaactaaacatggccaaagtgttgtcccgactgagaaactttggaagcagaataaaggctcaaaggaacatttaaaagaagaggatgatatataatcaaaagtggcgacaaagaagtgtgtacgacccactcgagattgacgaaggacagcttctttgttcttttgtgtgttactgaatatgtaataatcttgtatagattggtttttaaaatacggtggcaaattaaagacgatatcacttacaaagacatggacaatgtggaggggccaaaagttatataaacgacacgccgaatcggtgatgaacaccacatgcctcccataaagacggtgtatcaatctttgatataatgggtatccgtttgaggcggcatttatacttgatctagtgaaattacaaggagaggaaaagaagtttaagagaatgataatgataatgaaaaaaatcggaggaaaaagaacatgaacaaagcaagaggagatagccgtgcacacaaaatagagataatttcctcttagaactatgaaaacttcctcttctttctgcaacactgatttgagtttttgttctctatctagcatttcagtccatcttgatgtcaagtgacatgtaaaaagacgtattgcccccattgctgttttaaattgtctccacacttgacaacaatttaatgagttgttaaaatattatgtgtgtttatggccaattatactttttagttttgagtttttcatgaagtcattaagatgctaaaaataatataaagttgtcaatgcttgtcggaagccccaatatgtgactaaaatgctgctaaaagtttatagcatttttttaaaaatctaaacaaattgaaaaaagaaatccaaactagaaattgtagatcttatcgaaaactataagttttatataaaaggcgactttatctaacaccacacaagaaagatgtgctttttctaagaagacaagtcttagtatgtgattaatatgctactgaaaatttatattatttttaagcattttaataacctcaaatggaaacatacaaaactaagttgcagatcttatcaagagctataatttttatataaaatgtatatttaaataacaccatacaagaaagatatatgattttttctaagacgacaaagctttgtatgcaatttaatatgttgctaaaaaatcatattattttttttatcatcttaacgtcctcaaataaaaaaaaatcagactagttggtatagacctcatcgaggctacaatttttataaaaactcaacttcatccggtgttgtataaaaatgatataatttttcctagatagagcgttgccataagtgtattttggtcaagaaatatatgtatacttattaatgaaatcctaacaaaatatactttaaaatctgacggaaatgttggataggaaacaaaagcttaaatcaatgctaaatagggaagttttcatcatagttataatgagtgatttctccacaaaatatgatgtaccacatgttaaatattactcgcgcacaaataatcagagcatattactttcatagcgtggtcgtggccatggcctagacttggttgtggacgtctcacttcaccaattgatagaaaaaaaacatttataagaaagaaaagatacagaaaccatcacacgcgacaacatgacttgccgaaacacaaaaccaaaacccaaactcgagaagatgctttcgagaaaaagcctgaaaagaaaaaaaatttgcacgtaaaatcaaattcggacggcgaagagggcaaacgagacagacaactgggtccacttgctgataaaaaagagagagaggagggcccacttgccggcgggcacccctcagactgtctccaacaatactgacgcaaacagaagacgcattggatgcaatgcgttgcgctgtggcaaaaaattaggtacctatttctagtgtattccaacagagaacgcaaaagaagatgccgtactgcgccatgcattcatgtgggaccggggaggatgcgggcaacagcagtttgcacgacccattggccggagcatgcgacgtatatttgcgttgcgcctcgcttcctacgcaaaatgtgtcgttggtatgcctaccctgttggagggcgttttcttctgctaaagtaacgtggagcacgcatttgcgtaggctgttggagatagtctcaccacgcggtgaccggaccaggccaattcccgagcccaaaaagaaaaaagcacacacacagagacacacgctctcgctctcgcctccctgacgctggatttaagcagagcagggagcagaggtgcaaccgcccaccacgatctcccctcccgcacgccccgcgggcagacccagccaaggcaaggcagccgcgaaccggagcacgccggccggtgtcgcctcccgcgccggcggcctgctgctcgctcgccctcgcttccgcattggatcacgcggcggttggcgacttggtggtgtctgctgctggtgattgcgcctagccggccgacgcggagacggtgaggcgctgctcttcgcttctctccccactgctcccctcagcggtttctctctccctgttatgcgtggaggagccctgcccccgcggaacggaagcctccgccggatctctgttacgccgcggttactgcctcgccctggatttgaacttgtttcgtaattttcccttgctgcgcttctcgatttcggggaggggttctgccggcagctctgccgctccacctgacttggggacctttctatgttccgcgacagcagcattgatgatctgcttgtctcttgagtttttttttcgtgcgatgcatcgagcgcgtggggacacgatcacgcctgatgggcggtagtccgcgatccgcatttctgaatcccggcgcctagccgaggtgcctcggtgcttcctggttgccttgctgctattcccttcttcggatccgctctcgtacggctggcacggtggttgcggccttagaatttcgtggcggcggtttggttggattggtgatgctgctccgtccgcatttatgaaggaatgttctccaaacttttaagctgctcgtgtactcggagtattgaattgcctgttccttgccgctataggaggccctgggccagcctaccccgctttgggttgtgattggtgatttccggcagctgttattgtttcatgattcgtgtggggaaaaaaagtttttttggttcacgagtggtttctggtgcatgttttgacaagttttctatgatgctggtactgtctttacccctgctagagtagtttggtggtgcgttttcctattaggtgggaatttaatcactttcccactttatcgtatctctactatggtaaccatcttttggcaattttgattggtatagtcatgtttaagataagcttttgaattcaatgatcttgccgttcattagctagcacttaattttgtagagctgcttggatcaccaaagtgccgctcaatcttgttcaagtgcctatgatatatgggattctgatggaactcttagcagtcgtgtccttaggcagtcggcaccttgataaggttccaagagttcaatcttacggaagaaatagtgagcttgatctgagttcagatcggttgtcttcacacttcacgattaattaccacgtttttaaggtgtgcattctcacttctttacttccatcgtcaatcttcttaactggttgggttggaggtgtggtcatgcacccaaccacataggttgagtcctcttcaactcgaatttaggtgcctatttttttcttaataaaaaaggccacctgattctccttggttggtcacatttttttcttaataaaaaaaggccacctcaatgtttctccttttagcttgagcactttttctggatctcctctttcttcttaattctgatccaagtgtcatcagcgttatatttatttgaacctgcttgcttttgtaagcctgatcagtttgcaaaagttactagaacaatttaaccatctgtgcttgttatttctgcaggcatcaagtttctaacaatttgaagtacctaaa

SEQ ID NO: 250 - DNA, 297 bp, Sorghum bicolor
atggtggtcagcgcattcactggacccgggattgggatcgggttcggtgtcggctgcgggttcggcgtcgggtgggggttcggagggatgcctcttaacatgtttggcttgggtattggtgggggctgcggagttggtcttggactaggatggggctttggaaatgcttttggttgtcagtatcgatcttcaagagtccagttccagggcattgaatttcagaagaaggttgaaggagatgaagcaccaaaagttgtttcacaggagcttgctgaaaaatctcgtccttatggctag

SEQ ID NO: 251 - protein, 98 aa, Sorghum bicolor
MVVSAFTGPGIGIGFGVGCGFGVGWGFGGMPLNMFGLGIGGGCGVGLGLGWGFGNAFGCQYRSSRVQFQGIEFQKKVEGDEAPKVVSQELAEKSRPYG

SEQ ID NO: 252 - DNA, 297 bp, Zea mays
atggtagtcagcacgttcaatggacccgggattgggatcgggttcggtgtcggctgcgggttcggcgtcgggtgggggttcggaggaatgcctcttaacatgttcggcttgggtatcggtgggggttgtggatttggtcttggactaggatggggctttggaaatgcttttggttgtcagtatcgatcttcaagagttcagttccaaggcattgaatttcagaagaaggcggaaggagatgatgcaccaaaagttgtttcaccggagcttgctcaaaagtctcgtccttatggctag

SEQ ID NO: 253 - protein, 98 aa, Zea mays
MVVSTFNGPGIGIGFGVGCGFGVGWGFGGMPLNMFGLGIGGGCGFGLGLGWGFGNAFGCQYRSSRVQFQGIEFQKKAEGDDAPKVVSPELAQKSRPYG

SEQ ID NO: 254 - DNA, 1533 bp, Sorghum bicolor
atggcgacggcgatgggcgcgttggctgccacctccctgaccccggtcccggctgccgctacgttccccggtgatctcggcctcggacgccgccgggcggctgtgtcagggtggcgcgccggcgggagacggctgcgtgcgtcgccgcctgcccggaggccgttcctgttctcgccgaggggcgtttcggactctcggagctcgcaaacgtgccttgatccggacgccagcacgagtgttcttgggatcatccttggaggtggtgctgggacaaggctgtatccactgacgaagaagagggcgaaaccagcagtgccgttgcgcgccaactacaggctcatagatatccctgtcagcaactgtctgaacagtaacgtctccaagatatatgtgctaacacagttcaactctgcttcgctcaaccgccacctctcaagggcctatgggaacaacattgccgggtacaagaatgagggattcgttgaggtccttgcagcacaacagagtccagagaatcccaactggtttcagggtactgcagatgctgtgcgtcaatatatgtggctatttgaggagcacaatatcatggagttccttattctggctggagatcacctgtaccgtatggactaccaaaagttcattcaagcccatagagaaacagatgctgatataactgttgcagccctgccaatggatgaacaacgtgcaactgcatttggtcttatgaaaattgatgatgaagggagaatagttgagtttgcagaaaaaccaaaaggagagaagctgagatcaatgatggttgacaccactatattgggccttgatcctgagagggccaaggaactgccttatattgctagtatgggaatctatgtttttagcaaagatgtgatgcttcggcttctcagagaaaactttcctgcagcaaatgactttggaagtgaggttattcctggcgcaacagaaattggattaagggtgcaagcttacttatatgatggttactgggaagatattggtactattgaagcattttataatgcaaacttgggaataaccaagaaacctgtaccggattttagcttctatgaccgttctgctccaatttatacgcaacctagatacttgcctccttcaaaggttcttgatgccgatgtgacagacagtgttattggcgaaggttgtgttattaaacattgcacaatcaaccattctgtagttggactccgttcctgcatttctgaaggtgcagttatagaggattctttgctgatgggtgcagactattatgagactgaggatgataagaaagtcctttctgagaatggtggcattcccattggtattgggaagaatgcacatatcagaaaagcaataatcgacaaaaatgctcgtattggagaaaatgtgaagataatcaattttgataatgtccaagaagcagtaagggagacggaaggatactttatcaaaagtggcattgtcacagtgattaaagatgccttaatccctagtggaaccatcatataa

SEQ ID NO: 255 - protein, 510 aa, Sorghum bicolor
MATAMGALAATSLTPVPAAATFPGDLGLGRRRAAVSGWRAGGRRLRASPPARRPFLFSPRGVSDSRSSQTCLDPDASTSVLGIILGGGAGTRLYPLTKKRAKPAVPLRANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETEDDKKVLSENGGIPIGIGKNAHIRKAIIDKNARIGENVKIINFDNVQEAVRETEGYFIKSGIVTVIKDALIPSGTII

SEQ ID NO: 256 - DNA, 1554 bp, Zea mays
atggcgatggcagccatagcctccccgtcgtcgaggaccctgatccctccgcgacaccacggcgccgcgccctccccgtccacctccggcgactcctcgctccgcctcctctgcgcacacccgcgccacggacggcgcggccgggcgatgtccgtctcgacgcccgcggcgcggagccggccgttcgtcttctccccgcgcgcggtgtccgactctaagagctcccagacctgcctcgaccccgacgccagcacgagtgttcttggaatcattctcggaggtggtgctgggactagattgtaccccttgacaaagaagcgtgccaagcctgcagtgccattgggtgccaactatagactgattgatatccccgtcagcaattgtctcaacagcaacatatccaagatctatgtgctaacacaattcaactctgcttccctcaaccgtcacctctcaagagcctacgggaacaacattggagggtacaagaatgacgggttcgttgaagtcttagctgcacagcagagcccagataatccaaactggtttcagggtactgcagatgctgtaaggcaatacttgtggttatttgaggaacataatgtgatggagtttctaattcttgctggcgatcacctgtaccggatggattatgaaaagttcattcaggcacacagagaaacggatgctgatattactgttgctgccctaccaatggatgagaaacgtgcaaccgcatttggcctcatgaaaattgacgaagaagggaggattattgagtttgctgagaaaccgaaaggagatcagttgaaagcaatgatggttgacaccaccatacttggccttgatgacgagagggcaaaggaaatgccttatattgctagcatgggtatatatgtttttagcaaggatgtaatgcttcagctcctccgtgaacaatttcctggagccaatgattttggaagtgaggttattccaggtgcaacaagcattggaaagagggttcaggcttatctatatgatggttattgggaagatattggtacaattgaggcattttataatgcaaacttgggaataaccaagaagccaataccagatttcagcttctatgaccgttctgctccaatctatacacaacctcgacatctgccaccttcaaaggttcttgatgctgatgtgacagacagtgttattggtgagggatgtgttattaaaaactgcaagatacaccattctgtagttggactccgttcttgcatatctgaaggtgctatcatagaggacactttactaatgggtgcggactactatgagactgaagctgacaagaaactccttgccgaaaatggtggcattcccattggtattgggaagaattcacacatcagaaaagcaatcattgacaagaatgctcgaattggagataatgtgaagatactcaacgctgacaatgttcaagaagctgcaagggagacagacgggtacttcatcaaaggtggaattgtcacagtgatcaaggatgctttactccctagtgggacagttatatga

SEQ ID NO: 257 - protein, 517 aa, Zea mays
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 258 - DNA, 2049 bp, Sorghum bicolor
atgtcgctcctgcggcggcggaagcagccgcagccgccgccgccgccctcggacggcgacgggtccgaccacgacgacagcgacaaggggaagaagccgtcctcgtcctcgtcctccgcgccgccgtccaaggaggccacgaggcggaccaaggccaagtggtcgtgcgtggacagctgctgctggctggtcgggtgcgtgtgctccgcctggtggctgctgctctttctctacaacgcgatgccggcctcgttcccgcagtatgtcacggaggccatcacggggccgctcccggaccctcccggggtcaagctgcagaaggaggggctccgtgttaagcaccccgtcgtcttcgtccccggcatcgtcaccggagggctcgagctatgggagggccaccagtgcgccgaggggctcttccgcaagcggctatggggcggcacatttggtgacgtatacaagagacctctatgctgggttgaacatatgtctttggacaacgaaacaggattagacaaacctggaataagggttaggccagtcacaggccttgttgcagcagactatttcgttcctggatattttgtttgggctgtcttaattgccaatttagctcgtattggatatgaagaaaagaccatgtacatggctgcatatgattggaggttatctttccagaacactgaggttcgtgatcaaactttgagcagaataaagagcaacattgaactcatggtagcaacaaatggtggaaatagggtggtagtgatcccgcactccatgggggtcctctattttctgcattttatgaaatgggttgaagcacctcctcccatgggaggcggcggcggtccaaactggtgtgagaagcatattaaagctgtaatgaatattggtggacctttcttaggagttcccaaggcagttgctgggcttttctcatctgaagccaaagatgttgccgttgctagagctattgctcctgatgttctggactccgattttcttgggctccaaactttgcgccatttgatgcgtatgacccgaacatgggattcgacaatgtcaatgattcctaaaggtggtgatacaatttggggaaatctggattggtctccagaagatggccttgaatgtaaagctaagaagcacaaaaccaatgataccgaggtttctaaggatagcaatggggaaaatgtcgaagttcaacctgagcctattaactatggaaggctggtatcctttggtaaagatgtagcggaagcaccttcttcagagattgagcagatagaatttcgtgatgctgttaaaggtaatagtattgcccattcaaatacttcatgccgggagatctggacagaatatcatgaattaggatggggtggaataaaggcagttgaggactacaaagtttacactgctagttctgttatagacctccttcacttcgttgctccaaggatgatgcagcgtggaaatgtccacttctcatatggaattgctgataacttggatgatccgaaataccaacattacaaatattggtcaaaccccttggaaacaaagctaccgaatgctcctgacatggaaatattttcgatgtacggagtaggcattcctaccgaaagggcatatgtctataaggttgccccgcaggcagagtgtaatatacctttccggattgactcctcggctgaaggtggggaggaaaatagctgcttgaaagggggtgtttacttagctgatggtgatgaaactgttccagttcttagtgcgggctacatgtgtgcaaaaggatggcgtggcaaaactcgtttcaaccctgccggcagcaagacttacgtgagagaatacagccattcaccaccctcgactctcctggaaggcaggggcactcagagcggtgcacatgttgatataatggggaactttgctctgattgaggacatcatcagaatagctgctggggcaaccggtgaggaaattggtggcgaccaggtttattcagatatattcaaatggtcagagaagatcaaattgaaattgtaa

SEQ ID NO: 259 - protein, 682 aa, Sorghum bicolor
MSLLRRRKQPQPPPPPSDGDGSDHDDSDKGKKPSSSSSSAPPSKEATRRTKAKWSCVDSCCWLVGCVCSAWWLLLFLYNAMPASFPQYVTEAITGPLPDPPGVKLQKEGLRVKHPVVFVPGIVTGGLELWEGHQCAEGLFRKRLWGGTFGDVYKRPLCWVEHMSLDNETGLDKPGIRVRPVTGLVAADYFVPGYFVWAVLIANLARIGYEEKTMYMAAYDWRLSFQNTEVRDQTLSRIKSNIELMVATNGGNRVVVIPHSMGVLYFLHFMKWVEAPPPMGGGGGPNWCEKHIKAVMNIGGPFLGVPKAVAGLFSSEAKDVAVARAIAPDVLDSDFLGLQTLRHLMRMTRTWDSTMSMIPKGGDTIWGNLDWSPEDGLECKAKKHKTNDTEVSKDSNGENVEVQPEPINYGRLVSFGKDVAEAPSSEIEQIEFRDAVKGNSIAHSNTSCREIWTEYHELGWGGIKAVEDYKVYTASSVIDLLHFVAPRMMQRGNVHFSYGIADNLDDPKYQHYKYWSNPLETKLPNAPDMEIFSMYGVGIPTERAYVYKVAPQAECNIPFRIDSSAEGGEENSCLKGGVYLADGDETVPVLSAGYMCAKGWRGKTRFNPAGSKTYVREYSHSPPSTLLEGRGTQSGAHVDIMGNFALIEDIIRIAAGATGEEIGGDQVYSDIFKWSEKIKLKL

SEQ ID NO: 260 - DNA, 2037 bp, Zea mays
atgtcgctcctgcggcggcggaagcagcagcagctaccgccctcggagggcgacgggtccgaccacgacgacaacgacaaggggaagaagccgtcctcgtcctccgcgccgccgtccaaggagcccacgaggcggaccaaggccaagtggtcgtgcgtggacagctgctgctggctggtcgggtgcgtgtgctccgcctggtggttgctgctctttctctacaacgcgatgccagcttcgttcccgcagtatgtcaccgaggccatcacggggccgctcccggacccgcccggggtcaagctgcagaaggaggggctgcgagctaagcaccccgtcgtctttgtccccggcatcgtcaccgggggcctcgagctatgggagggacaccaatgcgctgagggtctcttccgcaagcggctatggggcggcacatttggtgacgtatacaagagacctctatgctgggttgaacatatgtcgttggacaatgaaactggattagacaaacctggaataagggtcaggtcagtcacaggccttgttgcagcagactatttcgtccctggatattttgtttgggctgtcttaattgccaatttagctcgtattggatatgaagaaaagaccatgtacatggctgcatatgattggaggttatctttccagaacactgaggttcgtgatcaaactttgagcagaataaagagcaatattgaactcatggtagcaacaaatggtggaaatagggtggtggtgatcccacactccatgggggtcctctattttctgcattttatgaaatgggtcgaagcacctcctcccatggggggcggtggtggtccgaactggtgtgagaagcatattaaagctgtaatgaatattggaggacctttcttaggagttcccaaggctgttgctgggcttttctcatctgaagccaaagatgttgccgttgctagagctatcgctcctgatgtcctggactctgattttcttggacttcaaactttgcgccatttgatgcgtatgacccgaacatgggattcaacaatgtcaatgcttcctaaaggtggtgatacaatttggggaaatctggattggtctccagaagatggccttgaatgtaaagctaagaagcataaaaccaatgataccgaggtttctaaggatagcaatggggaaaatatcgaagttcaacctgaacctataaactacggaaggctggtatccttcggtaaagatgtagcagaggcaccttcttcagagattgaacagatagaatttcgtgatgctgttaaaggtaacgatatcgtccattcaaatgcatcatgccgggagatctggacagagtaccatgaattaggatggggtggaataaaggcagtcgcagactacaaagtttacactgccagttctgttatagaccttcttcactttgttgctccaaggatgatgcagcgtggaaatgtccacttttcatatggaattgctgataacttggatgatccgaaatatcaacattacaaatattggtcaaaccccttggaaacaaagctaccgaatgctcctgacatggaaataatttccatgtacggagtaggcattcctactgaaagggcatatgtctacaagttggctccacaggcagagtgctatataccattccggattgacgcctcggctgatggcggggaggaaaacaaatgcttgaaagggggtgtttacttagctgacggcgacgaaactgttccagttcttagcgcgggctacatgtgtgcaaaagggtggcgtggcaaaactcgtttcaaccctgccggcagcaagacttacgtgagagagtacagccattcaccaccctcaactctcctggaaggcaggggcactcagagcggtgcacatgttgatataatggggaacttcgctttgatcgaggacatcatcaggatagctgccggggcaaccggtgaggaaattggtggcgaccaggtttattcagatatattcaaatggtcagagaaaatcaaattgaaattgtaa

SEQ ID NO: 261 - protein, 678 aa, Zea mays
MSLLRRRKQQQLPPSEGDGSDHDDNDKGKKPSSSSAPPSKEPTRRTKAKWSCVDSCCWLVGCVCSAWWLLLFLYNAMPASFPQYVTEAITGPLPDPPGVKLQKEGLRAKHPVVFVPGIVTGGLELWEGHQCAEGLFRKRLWGGTFGDVYKRPLCWVEHMSLDNETGLDKPGIRVRSVTGLVAADYFVPGYFVWAVLIANLARIGYEEKTMYMAAYDWRLSFQNTEVRDQTLSRIKSNIELMVATNGGNRVVVIPHSMGVLYFLHFMKWVEAPPPMGGGGGPNWCEKHIKAVMNIGGPFLGVPKAVAGLFSSEAKDVAVARAIAPDVLDSDFLGLQTLRHLMRMTRTWDSTMSMLPKGGDTIWGNLDWSPEDGLECKAKKHKTNDTEVSKDSNGENIEVQPEPINYGRLVSFGKDVAEAPSSEIEQIEFRDAVKGNDIVHSNASCREIWTEYHELGWGGIKAVADYKVYTASSVIDLLHFVAPRMMQRGNVHFSYGIADNLDDPKYQHYKYWSNPLETKLPNAPDMEIISMYGVGIPTERAYVYKLAPQAECYIPFRIDASADGGEENKCLKGGVYLADGDETVPVLSAGYMCAKGWRGKTRFNPAGSKTYVREYSHSPPSTLLEGRGTQSGAHVDIMGNFALIEDIIRIAAGATGEEIGGDQVYSDIFKWSEKIKLKL

SEQ ID NO: 262 - DNA, 846 bp, Sorghum bicolor
atgccgccgcccagcctcaccgcggccgccgccaccaccacaacgcgccgccgcaaggaccacccggcgccgggcggaggcgcgggggcgaaggagatgggcgcggcggcggcgtccgcggcggaggggtgggcgcggcggccggagtggtgctcggcggcgggcgtggcgggcgtgctgcggcggcacccggcgcccgcgctcttcgggtgcggcctcctgctcttcatggccgtcgagtacaccatccccatggtcaggccggactccccgccgctcgacctgggattcatcgccaccaggaacatgcacgccgccgtcgccgccacgccctggctcaactcgctcctcgccgcgctcaacacggtcatcgtcgcgatgcaggcggcgtacatcctgtgggcgatcctggcggagcagcggccgcgggcggccgtcgcggcgctgatgatgttcacctgccggggcgtgctgggctgcgccacgcagctgccgctgcccgaggagttcctggggtccgggatggacttccccgtgggcaacgtctccttcttcctcttcttctcgggccacgtcgcgggcgcggtgatcgcggccgccgacatgcgccgcgagggacgggcggcgctcgcgcgcctctacgacgcgctcaacgtgctccaggcggtcaggctgctcgcgtgcaggggacactacaccatcgacctggctgtcggcgtcggggccggggtcctcttcgacacgctctccgggtggtacttcgacgccaagaacggcgacggcaagaacgcgcccgagaagcactgccgtagctgccagtgccacaaggctctcctctcacactag

SEQ ID NO: 263 - protein, 281 aa, Sorghum bicolor
MPPPSLTAAAATTTTRRRKDHPAPGGGAGAKEMGAAAASAAEGWARRPEWCSAAGVAGVLRRHPAPALFGCGLLLFMAVEYTIPMVRPDSPPLDLGFIATRNMHAAVAATPWLNSLLAALNTVIVAMQAAYILWAILAEQRPRAAVAALMMFTCRGVLGCATQLPLPEEFLGSGMDFPVGNVSFFLFFSGHVAGAVIAAADMRREGRAALARLYDALNVLQAVRLLACRGHYTIDLAVGVGAGVLFDTLSGWYFDAKNGDGKNAPEKHCRSCQCHKALLSH

SEQ ID NO: 264 - DNA, 849 bp, Zea mays
atgccgccgcccagcctcaccgccgccggcaccaccaccaccacaacccgccgccgcaacgaccgagccgcgaaggtccaccaggtactgggcgaaggcgcggggacggaggagatgggcgcggtggcggacgggtggacgcggcccgagtggtgctcggcggcgggcgtcgcgggcgtgctgcggcggcacccggcgcccgcgctcttcgggtgcggcctcctgctcttcatggccgtcgagtacaccatccccatggtcaagccggacgcgccgccgctcgacctaggcttcctcgccaccgcgggcatgcacgccgccatcgccgcgaggccctggcttaactcgctcctcgccgcgctcaacacggtcttcgtcgcgatgcaggcggcgtacatcctgtgggccatcctcgccgagcagcggccgcgcgcggccgtcgccgcgctcatgatgttcacttgccggggcgtgctgggctgcgccacccagctcccgctgccggaggagttcctgggctccgggatggacttccccgtgggcaacgtctccttcttcctcttcttctcgggccacgtcgcgggcgcggtgatcgcggcggccgacatgcggcgcgaggggcggctggcgctggcgcgcctcttcgactcgctcaacgtgctccaggtggtcaggctgctcgcgtgcaggggacactacaccattgacctggctgttggcgttggsgcgggcatcctcttcgacacgctctccggatggtacttcgacgccaagaacggcgatagcagcaacgcaccggagaagcagtgccggagctgccagtgccacaaggccctcctttcacactag

SEQ ID NO: 265 - protein, 282 aa, Zea mays
MPPPSLTAAGTTTTTTRRRNDRAAKVHQVLGEGAGTEEMGAVADGWTRPEWCSAAGVAGVLRRHPAPALFGCGLLLFMAVEYTIPMVKPDAPPLDLGFLATAGMHAAIAARPWLNSLLAALNTVFVAMQAAYILWAILAEQRPRAAVAALMMFTCRGVLGCATQLPLPEEFLGSGMDFPVGNVSFFLFFSGHVAGAVIAAADMRREGRLALARLFDSLNVLQVVRLLACRGHYTIDLAVGVGAGILFDTLSGWYFDAKNGDSSNAPEKQCRSCQCHKALLSH

SEQ ID NO: 266 - DNA, 2223 bp, Sorghum bicolor
atggggggcgccgtgttggtcgccatcgcggcctctatcggcaacttgctgcagggctgggacaatgcgacaattgctggagcggtcttgtacataaagaaggaattcaacttgcagagcgagcccctaattgagggcctcatcgtggccatgtccctcattggggcaacagtcatcacgacgttctctggggcagtggccgactctgttggtaggaggcccatgctgatcgcctcggctatcctctactttgttagtgggctggtgatgctctgggcgccaaatgtgtatgtcttgctccttgcaaggcttatcgatgggtttggtattgggttggccgtcacacttgttcctttgtacatttctgagactgcgccgacggatattcgagggctgttgaacacactaccgcagttcagtggttcaggagggatgttcctttcctactgtatggtgtttggaatgtccctcatgcccacacctgattggaggctcatgcttggagttctgtcgatcccatcacttatttactttggattgactatcttctacttgcctgaatcaccaaggtggctcgtgagtaaaggaaggatggctgaggcaaagcgagtgttgcaaaggctgcggggaagggaagatgtctcaggggaaatggctcttctagttgaaggtttgggggttgggaaagatacacgtattgaagaatacataattggccctgatgacgagcttgctgatgaagggctggctcccgatccagagaagatcaaattatatggacctgaagaaggtctatcttgggttgcccgacctgttcggggacaaagtgctcttggaagcgcattaggtctcatctctcgtcatgggagtatggctagtcagggtaagcccctcgtggatcctgtggtcactcttttcggaagtgttcatgaaaagatgcctgagataatggggagcatgaggagcacattgtttcccaactttggcagcatgtttagtgttgccgaacagcagcaggtgaaggctgactgggatgccgagagtcaaagggagggtgacgattatgcttcagatcatggtggcgatgacattgaggataacctccaaagcccacttatttctcgtcaagcaacaagtgtggaaggaaaggagattgctgcacctcatggtagcataatgggtgctgtgggaagaagcagtagcctgcagggaggggaggcagtaagcagcatgggcattggtggaggatggcagttggcgtggaaatggactgagagagagggcgaagatggggaaaaggaaggtggcttccagcgtatttatttgcatgaggagggcgtacaaggcaggggttctatattgtcattaccaggaggggatgttcctcctggtggtgagttcgtccaggctgcagctcttgtgagtcaaccagctctttactcaaaggaactgctggagcaacgtgctgctggtcctgcgatgatgcatccatctgaggcagttgctaaaggtccaagatgggctgacctgtttgagcctggagtgaagcatgcactgtttgttggcataggaatacagatcctgcaacagtttgctggcatcaatggtgttctctactacactcctcaaattcttgagcaagcaggtgttggtgttcttctgtcgaacattggccttagcgcatcttctgcatcaattcttattagtgccttgacaaccttattgatgcttccaagcattggtattgcaatgaggctcatggatatgtctggaaggaggtttcttctccttgcgacaatccctatcttgatagttgccctagctatcttggtcgtggtcaatattgtggatgtgggaaccatggtgcatgctgcactctccacgattagtgtcatagtctatttctgcttctttgtcatggggtttgggcctattcccaacattctctgtgcagagatctttcccaccaccgtccgcggcatctgcatagccatctgcgccttaaccttctggattggtgacattatcgtgacatacacacttcctgtgatgctgaatgccatcgggctcgctggtgtctttgggatatacgccgtcgtttgcatcctggctcttgtatttgtattcatcaaggtgccagagacaaagggcatgcctctcgaggtcatcactgagttcttctccgttggagcaaagcaagccaaggaagccagggaagattaa

SEQ ID NO: 267 - protein, 740 aa, Sorghum bicolor
MGGAVLVAIAASIGNLLQGWDNATIAGAVLYIKKEFNLQSEPLIEGLIVAMSLIGATVITTFSGAVADSVGRRPMLIASAILYFVSGLVMLWAPNVYVLLLARLIDGFGIGLAVTLVPLYISETAPTDIRGLLNTLPQFSGSGGMFLSYCMVFGMSLMPTPDWRLMLGVLSIPSLIYFGLTIFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMASQGKPLVDPVVTLFGSVHEKMPEIMGSMRSTLFPNFGSMFSVAEQQQVKADWDAESQREGDDYASDHGGDDIEDNLQSPLISRQATSVEGKEIAAPHGSIMGAVGRSSSLQGGEAVSSMGIGGGWQLAWKWTEREGEDGEKEGGFQRIYLHEEGVQGRGSILSLPGGDVPPGGEFVQAAALVSQPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILALVFVFIKVPETKGMPLEVITEFFSVGAKQAKEARED

SEQ ID NO: 268 - DNA, 2244 bp, Zea mays
atggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctttgggcgccaagtgtgtacatcttgctcctcgcaaggctcattgatgggttcggtatcggtttggcggtcacacttgttcctctctacatctccgagactgcaccgacagacattcgtgggctgttgaacacgttgccgcagttcagtgggtcaggagggatgttcctctcctactgcatggtgtttgggatgtccctcatgcccaaacctgattggaggctcatgcttggagttctgtcgatcccgtcacttatttactttggactgactgtcttctacttgcctgaatcaccaaggtggcttgtgagcaaaggaaggatggcggaggcgaagagagtgttgcaaaggctgcggggaagagaagatgtctcaggggagatggctcttctagttgaaggtttgggggtcggtaaagatacacgtattgaagaatacataattggtcccgatgatgaacttgctgatgaagggctggctccagatccagagaagatcaaactatatggacctgaagaaggcctatcttgggttgcccgacctgttcggggacaaagtgctcttggaagcgcgttaggtctcatctctcgtcatgggagtatggcggctagtcagggtaagcccctcgtggatcctatggtcactcttttcggaagtgttcatgaaaagatgcctgagatcatggggagcatgaggagcacattgtttcccaactttggcagcatgtttagtgttgccgaccagcagcaggtgaaagctgactgggacgccgagagtcaaagggaaggtgaagattatgcttcggatcatggtggcgatgacatcgaggataacctccaaagcccacttatttctcgtcaggcaacaagtgtggaaggaaaggagatcgctgcacctcatggtagcatattgggtgctgtgggaaggagcagtagcttgcagggaggggaggcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacagtttgctggcatcaacggcgttctctactacactcctcaaattcttgagcaagcaggcgttggtgttcttctgtcgaacctcggccttaacgcttcttcggcatcaatcctcattagcgccctgacgaccttactgatgctcccaagcatcggcattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctggctcggtgacatcatcgtgacgtacactctccccgtgatgctgaacgtcgtcgggctcgccggcgtctttggggtgtacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggccagggaaggttga

SEQ ID NO: 269 - protein, 747 aa, Zea mays
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLLARLIDGFGIGLAVTLVPLYISETAPTDIRGLLNTLPQFSGSGGMFLSYCMVFGMSLMPKPDWRLMLGVLSIPSLIYFGLTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMAASQGKPLVDPMVTLFGSVHEKMPEIMGSMRSTLFPNFGSMFSVADQQQVKADWDAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMRLMDMSGRRFLLLATIPVLIVALLVLVVSNIVDVGDVAHAALSTASVIVYFCFFVMGFGPVPNILCAEIFPTTVRGVCIAICALAFWLGDIIVTYTLPVMLNVVGLAGVFGVYAVVCVLALAFVFVKVPETKGMPLEVITEFFSVGAKQAKEEEEEEAREG

SEQ ID NO: 270 - DNA, 2238 bp, Sorghum bicolor
atgtcgggggctgttcttgtcgccatcgccgcctccatcggcaatctgttgcaggggtgggacaatgccaccatcgcaggtgctgttctgtacataaagaaggaattccaattacaaaatgagcccactgtggaggggctgattgtggccatgtcacttattggtgccaccatcatcactacattctctgggccagtatcagactggatcggccgccgccctatgctcatcctctcgtcaattctgtactttctcagcagcctcatcatgctatggtcccctaatgtctatgtcctgctgctggcacgcctcgtagacggattcggtattggcttggctgtcacgcttgtgcctttgtacatttcagaaacagcccctccagagattagaggtttgctgaatacactgccacagttcagtggatcaggagggatgttcttgtcatactgcatggtgtttgggatgtcactgttgccatcacctgattggagaattatgcttggggtgctcgcgataccttcattgttcttctttggattgacaatattttaccttcctgaatccccaagatggcttgttagcaaaggtcggatggcagaggcaaagaaggtgttgcaaaaattacgcagcaaagaagatgtctcaggtgaattgtcccttcttgttgaagggttggaggttggaggagacacttcgattgaagagtacatcattggccctgccactgacgcagccgatgatcatgttactgatggtgataaggaacaaatcacactttatgggcctgaagaaggccagtcatggattgctcgaccttccaagggacccagcatgcttggaagtgtactttctctcgcatctcgtcatggcagcttggtgaaccagagtgtaccccttatggatccgattgtgacactttttgggagtgtccatgagaatatgcctcaagctggaggaagtatgaggagcacattgtttccaaactttggaagtatgttcagtgtcacagatcagcatgccaaaaatgagcagtgggacgaagagaatcttcacagggacgatgaggagtatgcatctgatggtgcaggaggtgattatgaggacaatctccacagtccattgctgtccaggcagacaacaagtgcggaagggaaggacattgtgcaccatggtcaccgtggaagttctttgagcatgagaaggcaaagcctcttgggggaggctggagagggtgtgagcagcactgatattggtgggggatggcagcttgcatggaaatggtcagagaaggaaggtgaggatggtaagaaggaaggtggtttcaaaagagtctacttgcaccaagagggagttcctggctcaagaatgggctcaattgtttcacttcctggtggtggcgatgttcatgagggtggcgagtttgtacatgctgctgctttagtaagccagtcagcacttttctcgaaggatcttaccgaaccacgcatgtctggtgctgccatgattaacgcatccgaggtagccgccaaaggttcaagctggaaagatttgtttgaacctggtgtgaggcgtgccctgttagtcggtgttggaattcagatccttcaacagtttgctggaatcaatggtgttctgtactataccccacaaattctcgagcaagctggcgtggcagttcttctttccaatcttggtctcagctcagcatcagcatctatcttgatcagttctctcactaccttactgatgcttcctagcattggcttagccatgagacttatggatctttctggaagaaggtttttgctgctaggcacaattccaatcttgatagcatctttagttatcctggtcgtgtccaatgtgattgacctgggtacagtggcccatgctgcgctctccacagtcagtgtcatcatctacttctgctgctttgtcatgggatttggtcccatccccaacattctatgtgcagagatctttccaaccagggttcgcggtctctgcattgccatctgtgccttgacgttttggattggagacatcattgtcacctacagccttcctgtaatgctgaatgctattggactagcaggtgtttttggcatatatgcagtcgtatgcttgattgcctttgtgtttgtcttccttaaggttcctgagacaaagggaatgccccttgaagtcatcactgagttctttgcagttggtgcgaagcaagcggctgcaaaagcctaa

SEQ ID NO: 271 - protein, 745 aa, Sorghum bicolor
MSGAVLVAIAASIGNLLQGWDNATIAGAVLYIKKEFQLQNEPTVEGLIVAMSLIGATIITTFSGPVSDWIGRRPMLILSSILYFLSSLIMLWSPNVYVLLLARLVDGFGIGLAVTLVPLYISETAPPEIRGLLNTLPQFSGSGGMFLSYCMVFGMSLLPSPDWRIMLGVLAIPSLFFFGLTIFYLPESPRWLVSKGRMAEAKKVLQKLRSKEDVSGELSLLVEGLEVGGDTSIEEYIIGPATDAADDHVTDGDKEQITLYGPEEGQSWIARPSKGPSMLGSVLSLASRHGSLVNQSVPLMDPIVTLFGSVHENMPQAGGSMRSTLFPNFGSMFSVTDQHAKNEQWDEENLHRDDEEYASDGAGGDYEDNLHSPLLSRQTTSAEGKDIVHHGHRGSSLSMRRQSLLGEAGEGVSSTDIGGGWQLAWKWSEKEGEDGKKEGGFKRVYLHQEGVPGSRMGSIVSLPGGGDVHEGGEFVHAAALVSQSALFSKDLTEPRMSGAAMINASEVAAKGSSWKDLFEPGVRRALLVGVGIQILQQFAGINGVLYYTPQILEQAGVAVLLSNLGLSSASASILISSLTTLLMLPSIGLAMRLMDLSGRRFLLLGTIPILIASLVILVVSNVIDLGTVAHAALSTVSVIIYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 272 - DNA, 2238 bp, Zea mays
atgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttccaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtacgcatctgatggtgcaggaggtgactatgaggacaatctccatagcccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccaccgtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacagccttcctgtgatgctgaatgctattggactggcgggtgttttcagcatatatgcagtcgtatgcttgatttcctttgtgttcgtcttccttaaggtccctgagacaaaggggatgccccttgaggttattaccgaattctttgcagttggtgcgaagcaagcggctgcaaaagcctaa

SEQ ID NO: 273 - protein, 745 aa, Zea mays
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 274 - DNA, 1464 bp, Sorghum bicolor
atggtgccggaccagtggtacgacaccaacggcgtctggacaggctccgccaccacgctccccgacggccgcctcgccatgctctacaccggctccaccaacgcctccgtgcaggtgcagtgcctcgccgtccccgccgacgacgccgacccgctgctcaccaactggaccaagtacgagggcaacccggtcctgtacccgccgccggggatcgggcccaaggacttccgtgaccccaccacggcgtggttcgacccgtcggacaacacctggcgcatcgtcatcgggtccaaggacgacgccgagggcgaccacgccggcatcgccgtcgtctaccggaccaaggacttcgtcagcttcgagctcctccccggcctcctccaccgcgtcgcgaggacggggatgtgggagtgcatcgacttctaccccgtcgccacccgcggcaaggcgtccgggaacggcgtcgacatgtccgacgccttcggcaagaacggcgccattgttggggacgtcgtgcacgttatgaaggccagcatggacgacgaccgccatgactactacgcgctcgggaggtacgatgcggccaccaacgagtggacgccgctcgacgccgagaaggacgtcggcatcgggctccggtatgactggggcaagttttacgcgtccaagaccttctatgaccccgccaagcgccgccgcgtgctctggggatgggtcggcgagaccgactcggagcgcgctgacgtctccaagggatgggcatcgttgcagggtatcccccggacggtgctgctggacaccaagacgggcagcaacctgctgcagtggcccgtggaggaagcggagacgctgcgcaccaactccacggacctcagcggcatcaccatcgactacggctcggcgttcccgctcaacctccggcgcgccacgcagctggacatcgaggcggagttccagctcgaccgccgcgccgtcatgtcgctcaacgaggccgacgtggggtacaactgcagcacgagcggtggcgccgcggcccgcggtgccctcggccccttcggcctgctcgtcctcgccgaccagcacctgcgcgagcagacggccgtctacttctacgtggccaagggcctggacggctccctcaccacgcacttttgccaggacgagtcccggtcctccagcgccaacgacatcgtcaagcgcgtcgtcggcagctccgtccccgtgctggacgacgagaccacgctctcgctccgcgtgctcgtcgaccactccatcgtcgagagcttcgcgcagggcggaaggtcgacggcaacctcgcgcgtctaccccaccgaggccatctacgccaacgccggcgtgttcctcttcaacaacgccaccgccgcgcgcgtcaccgccaagaagctcgtcgtccacgagatggactcatcctacaaccacgactacatggtcacggacatctga

SEQ ID NO: 275 - protein, 487 aa, Sorghum bicolor
MVPDQWYDTNGVWTGSATTLPDGRLAMLYTGSTNASVQVQCLAVPADDADPLLTNWTKYEGNPVLYPPPGIGPKDFRDPTTAWFDPSDNTWRIVIGSKDDAEGDHAGIAVVYRTKDFVSFELLPGLLHRVARTGMWECIDFYPVATRGKASGNGVDMSDAFGKNGAIVGDVVHVMKASMDDDRHDYYALGRYDAATNEWTPLDAEKDVGIGLRYDWGKFYASKTFYDPAKRRRVLWGWVGETDSERADVSKGWASLQGIPRTVLLDTKTGSNLLQWPVEEAETLRTNSTDLSGITIDYGSAFPLNLRRATQLDIEAEFQLDRRAVMSLNEADVGYNCSTSGGAAARGALGPFGLLVLADQHLREQTAVYFYVAKGLDGSLTTHFCQDESRSSSANDIVKRVVGSSVPVLDDETTLSLRVLVDHSIVESFAQGGRSTATSRVYPTEAIYANAGVFLFNNATAARVTAKKLVVHEMDSSYNHDYMVTDI

SEQ ID NO: 276 - protein, 638 aa, Sorghum bicolor
METRDTTAPLPYSYTPLPAADAASAEVTGTGHRGGRSRRRSLCAAALVLSAALLLAVAALTGVGRRVDVVPGGAGSPRSTSSISRGPDAGVSEKTSGAWSGGGRLRSPVYYKGWYHLFYQYNPDGAIWGNKIAWGHAVSRDLIHWRHLPLAMVPDQWYDTNGVWTGSATTLPDGRLAMLYTGSTNASVQVQCLAVPADDADPLLTNWTKYEGNPVLYPPPGIGPKDFRDPTTAWFDPSDNTWRIVIGSKDDAEGDHAGIAVVYRTKDFVSFELLPGLLHRVARTGMWECIDFYPVATRGKASGNGVDMSDAFGKNGAIVGDVVHVMKASMDDDRHDYYALGRYDAATNEWTPLDAEKDVGIGLRYDWGKFYASKTFYDPAKRRRVLWGWVGETDSERADVSKGWASLQGIPRTVLLDTKTGSNLLQWPVEEAETLRTNSTDLSGITIDYGSAFPLNLRRATQLDIEAEFQLDRRAVMSLNEADVGYNCSTSGGAAARGALGPFGLLVLADQHLREQTAVYFYVAKGLDGSLTTHFCQDESRSSSANDIVKRVVGSSVPVLDDETTLSLRVLVDHSIVESFAQGGRSTATSRVYPTEAIYANAGVFLFNNATAARVTAKKLVVHEMDSSYNHDYMVTDI

SEQ ID NO: 277 - DNA, 2022 bp, Zea mays
atggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtccgagaagacgtccggcgcgtctgacgacggcggcaggctccgtggagccggcgggaacgccttcccgtggagcaatgcgatgctgcagtggcagcgcacgggattccacttccagccgcagaagaactggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgacgcggccgccaacgcctggacgccgatcgacgccggcagggacgtcggcatcggcctgcgctacgactggggcaagttctacgcgtccaagacgttctacgacccggccaagcgccgccgcgtgctgtggggatgggttggcgagacagactcggagcgcgcggacgtgtccaagggatgggcgtcgctgcagggtatcccccggacggtgctcctggacaccaagacgggtagcaacctgctgcagtggcccgtggaggaggtggagacgctgcgcaccaactccaccgacctcagcggcatcaccatcgactacggctccgtgttcccgctcaacctccgccgcgccacccagctggacatcgaggcggagttccagctggaccgccgcgccgtcatgtcgctcaacgaggcggacgtgggctacaactgcagcaccagcgggggcgccgccggccgcggcgcgctggggcccttcggcctgctcgtcctcgccgaccgccgcctccgccgcgagcagacggccgtctacttctacgtggccaagggcctggacggctccctcgccacgcacttctgccaggacgagtcccgctcctccagcgccaccgacatcgtcaagcgcgtcgtcggcagcgccgtccccgtgctggaggacgaggccacgctctcgctccgggtgctcgtcgaccactccatcgtcgagagcttcgcgcagggcgggaggtccaccgccacatcgcgcgtctaccccaccgaggccatctacgccaacgccggcgtcttcctcttcaacaacgccaccgccgcgcgggtcacggccacgaagctcgtcgtccacgagatggactcgtcatacaaccacgactacatggcgccggtggcagacatctga

SEQ ID NO: 278 - protein, 673 aa, Zea mays
METRDTDATPLPYSYTPLPAADAASAEVSGTGRTRSRRRPLCAAALVLSAALLLAVAALVGVGSRPGAVGMTESAASSPTPSRSRGPEAGVSEKTSGASDDGGRLRGAGGNAFPWSNAMLQWQRTGFHFQPQKNWMNDPNGPVYYKGWYHLFYQYNPDGAIWGNKIAWGHAVSRDLIHWRHLPLAMVPDQWYDTNGVWTGSATTLPDGRLAMLYTGSTNASVQVQCLAVPADDADPLLTNWTKYEGNPVLYPPPGIGPKDFRDPTTAWIDPSDGAWRVVIGSKDDDGHAGIAVVYRTTDLVHFELLPGLLHRVDGTGMWECIDFYPVATRGRASANGVDMSDAIASNGAVAGDVLHVMKASMDDDRHDYYALGRYDAAANAWTPIDAGRDVGIGLRYDWGKFYASKTFYDPAKRRRVLWGWVGETDSERADVSKGWASLQGIPRTVLLDTKTGSNLLQWPVEEVETLRTNSTDLSGITIDYGSVFPLNLRRATQLDIEAEFQLDRRAVMSLNEADVGYNCSTSGGAAGRGALGPFGLLVLADRRLRREQTAVYFYVAKGLDGSLATHFCQDESRSSSATDIVKRVVGSAVPVLEDEATLSLRVLVDHSIVESFAQGGRSTATSRVYPTEAIYANAGVFLFNNATAARVTATKLVVHEMDSSYNHDYMAPVADI

SEQ ID NO: 279 - DNA, 2451 bp, Sorghum bicolor
atgggggaagctgccggtgaccgtgttctgagccgcctccacagcgtcagggagcgcattggcgattcactctctgcccaccccaatgagcttgtcgccgtcttcaccaggctgaaaaaccttggaaagggtatgctgcagccccaccagatcattgccgagtacaacagtgctatccctgaggctgaacgtgagaagctgaaggatggtgcctttgaggatgtcctgagggcagctcaggaagcaattgttatccccccatgggttgcacttgccatccgccctaggcctggtgtctgggagtatgtgagggtcaacgtcagcgagctcgctgttgaggagctgagagtccctgagtacctgcagttcaaggaacagcttgtggaagaaggccccaacaacaactttgttcttgagctggactttgagccattcaatgcgtccttcccccgtccttctctgtcaaagtccattggcaatggtgtgcagttcctcaacaggcacctgtcatcaaagctcttccatgacaaggagagcatgtaccccttgctcaacttccttcgtgcccacaactacaaggggatgaccatgatgttgaacgacagaatccgcagtctcagtgctctgcaaggcgctctgaggaaggctgaggagcacctgtccaccctccaagctgataccccatactctgaatttcaccacaggttccaggaacttggtctggagaagggttggggtgactgcgctaagcgcgcacaggagactattcacctcctcttggaccttcttgaggccccagatccgtccaccctggagaagttccttggaacgatccccatggtgttcaatgttgttatcctctcccctcatggttactttgctcaagctaatgtcttgggttaccctgacaccggaggccaggttgtgtacattttggaccaagtccgtgctatggagaatgaaatgctgctgaggatcaagcagtgtggtcttgacatcacaccaaagatccttattgttaccaggttgcttcctgatgcaactggcaccacctgtggtcagcgtcttgagaaggtccttggcactgagcactgccatatccttcgtgtgccattcagaacagaaaatggaattgttcgcaagtggatctcgcgttttgaagtctggccttacctggagacttacactgatgatgtggcacatgagattgctggagagcttcaggccaatcctgacctgatcatcggaaactacagtgatggaaaccttgtcgcatgtttgctcgcgcacaagatgggtgttactcactgtaccattgcccacgcccttgagaaaactaagtaccctaactctgacctctactggaagaagtttgaggaccactaccacttctcgtgccagttcaccactgacttgattgctatgaaccatgctgacttcattatcaccagtaccttccaagagattgctggaaacaaggacaccgtcggtcagtacgagtcacacatggcattcacaatgcctggtctgtaccgcgttgtccacggtattgatgtgtttgaccctaagttcaacatcgtgtctcctggtgcggacttgtccatctacttcccatacaccgagtcacacaagaggttgacctccctccacccggagattgaggagctcctgtacagccaaaccgagaacaccgagcacaagtttgtgctgaacgacaggaacaagccaatcatcttctccatggctcgtcttgaccgcgtcaagaacttgactggtctggtggagctttatggccggaacaagcgcctgcaggagctggtgaacctcgtggttgtgtgcggtgaccacggcaacccgtccaaggacaaggaggagcaggccgagttcaagaagatgtttgacctcatcgagcagtacaacctgaacgggcacatccgctggatctccgcccagatgaaccgtgtccgcaacggtgagctgtaccgctacatttgcgacaccaagggtgccttcgtgcagcctgctttctacgaggcgttcgggctgacggtggttgaggccatgacctgtggcctgcccacgttcgccaccgcctatggtggtccggctgagatcatcgtgcacggcgtgtctggcttccacattgacccgtaccagggcgacaaggcgtcggcgctgctcgtggacttctttgagaagtgccagacggattcgagccactggaacaaaatctcccagggcgggctccagcgtatcgaggagaaatacacctggaagctgtactcggagaggctgatgaccctgacgggcgtgtatggtttctggaagtacgtgtccaacctggagaggcgcgagacccggcggtacctggagatgctgtacgcgctcaagtaccgcaccatggccagcaccgtgccgttggccgtggagggagagccctccagcaagtga

SEQ ID NO: 280 - protein, 816 aa, Sorghum bicolor
MGEAAGDRVLSRLHSVRERIGDSLSAHPNELVAVFTRLKNLGKGMLQPHQIIAEYNSAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGFHIDPYQGDKASALLVDFFEKCQTDSSHWNKISQGGLQRIEEKYTWKLYSERLMTLTGVYGFWKYVSNLERRETRRYLEMLYALKYRTMASTVPLAVEGEPSSK

SEQ ID NO: 281 - DNA, 2451 bp, Zea mays
atgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaaggatggtgcttttgaggatgtcctgagggcagctcaggaggcgattgtcatccccccatgggttgcacttgccatccgccctaggcctggtgtctgggagtatgtgagggtcaacgtcagtgagctcgctgttgaggagctgagagttcctgagtacctgcagttcaaggaacagcttgtggaagaaggccccaacaacaactttgttcttgagctggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtgccaggcggagccgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtga

SEQ ID NO: 282 - protein, 816 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 283 - DNA, 1680 bp, Sorghum bicolor
atggagctggctgtcggcggcgggatgcggcggtcggcgtcgcacacctcgctgtcggagtcggacgacttcgagctcacgcggctgctcagcaagccgcggatcaacgtcgagcgccagcgctccttcgacgaccgctcgctcagcgacgtctcgcactcgggcggctacggcaggggaggcttcgacggcatgtactcgcctgggggcggcctgcgctccctcgtcggcacgccggcatcctccgcgctgcactccttcgagccccaccccatcgtcggcgacgcatgggaggcgctccgccgctcactcgtcttctttcgcggccagccccttggcaccgtcgccgccgtcgaccacgcttccgaggaagtcctcaactacgaccaagtgtttgtgagggatttcgtgccgagcgcgctggcgtttctgatgaatggcgagccggatatcgtcaagaacttccttctgaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggagggttgcgcctgtggattctggtttctggtggatcatactcctccgggcgtacacaaaaaccaccggtgatatgaccctggcagagacaccggagtgccagaaagggatgaggctcatactcagcctgtgcttatctgaggggtttgataccttcccgacattgttatgtgctgatggttgctgtatgatagatcgcagaatgggtgtatatggataccctattgagattcaagcccttttctttatggcactaaggtgtgctcttcaaatgcttaagcatgataatgaagggaaggaatttgtagagaagattgctacccgccttcatgctttaagttatcacatgcgaagttatttttggctcgatttccaacagctaaatgacatttatcgttacaagacagaagaatattcccacacagccgtcaacaaattcaatgttattcctgattcaattccggactggctatttgactttatgccttgtcagggtgggtttttcattggtaatgttagtcctgccaggatggacttccgatggtttgcacttggaaacatgattgctatactttcttctcttgcaacacctgagcaatctgttgctataatggatcttattgaggagcgttgggaagagcttatcggtgatatgcctctgaagatatgttatcctgctattgagaaccatgaatggcgaattgtgacaggctgtgatccaaaaaatactagatggagctatcacaatggaggatcgtggccagtacttctgtggctgctgactgcagcctgcatcaaaactggacggccgcaaattgcaagaagagcaattgacctagcagagaggaggctgttgaaggatggctggcctgagtactatgacgggaagcttggtcggtatgttggcaagcaggcaaggaaattccagacttggtccatcgcggggtatttggtcgccaagatgatgttggaagatccttcacatcttggcatgatctccctagaagaggataaggcgatgttgaagcctgttttgaagcggtccgcatcatggacaaactaa

SEQ ID NO: 284 - protein, 559 aa, Sorghum bicolor
MELAVGGGMRRSASHTSLSESDDFELTRLLSKPRINVERQRSFDDRSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDMTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGDMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 285 - DNA, 1680 bp, Zea mays
atggagctggctgtcggcggcgggatgcggcggtcggcgtcgcacacctcgctgtcggagtcggatgacttcgagctcacgcggctgctcagcaagccgcggatcaacgtcgagcgccagcgctccttcgacgaccgctcgcttagcgacgtctcgcactcgggcgggtacggcaggggaggcttcgacggcatgtactcgcctgggggcggcctgcgctccctcgtcggcacgccggcctcctccgggctgcactccttcgagccccaccccatcgtcggcgacgcctgggaggcgctccgccgctccctcgtcttgttccgcggccagccccttggcaccgttgccgccgtcgaccacgcgtccgaggaagtcctcaactacgaccaagtgtttgtgagggatttcgtgccgagcgcgctggcgtttctgatgaatggcgagccagatatcgtcaagaacttccttctgaagaccctgctgctgcagggctgggagaagaaagtcgaccggttcaagctcggggagggtgccatgccggctagcttcaaggttatgcatgacgccaagaagggggtcgagaccctacatgctgattttggggagagcgccattgggagggttgcgcctgtggattcggggttctggtggatcatactcctccgggcctacacaaaaaccaccggtgatttgacgctggcagagacgccggagtgccagaaagggatgaggctcatactcagcctgtgcttatccgaggggttcgataccttcccgacattgttatgtgctgatggttgctgtatgatagatcgcagaatgggtgtatatggctaccctattgagattcaggcccttttctttatggcactaaggtgtgctcttcaaatgcttaagcatgataatgaagggaaggagtttgtagagaagattgctactcgccttcacgctttaagttatcacatgcggagttatttttggctcgatttccaacagctaaatgacatctatcgttacaagacagaagaatattcccacactgctgtcaacaaattcaatgtcattcctgattcaattccggattggctatttgactttatgccttgtcagggtgggtttttcattggtaatgtcagtcctgccaggatggacttccgatggttcgcacttggaaacatgattgctatactttcttcccttgcaacacctgagcaatctgttgctataatggatcttattgaggagcgttgggaagagctcattggtgaaatgcctctgaagatatgttatcctgctattgagaaccatgaatggcgaattgtgacgggctgtgatccaaaaaacactagatggagttatcataatggaggatcgtggccagtacttctgtggctgctgactgcagcctgcatcaaaactggacggccacaaatcgcaagaagggcaattgacctagcagaaaggaggctgttgaaggatggatggcctgagtactatgatgggaagcttggtcggtatgttggcaagcaggcgaggaaattccagacctggtccatcgcggggtatttggtcgccaagatgatgttggaagatccttcacatctcggcatgatctccctggaagaggatagggcaatgttgaagcctgttttgaagcggtctgcgtcatggacaaactga

SEQ ID NO: 286 - protein, 559 aa, Zea mays
MELAVGGGMRRSASHTSLSESDDFELTRLLSKPRINVERQRSFDDRSLSDVSHSGGYGRGGFDGMYSPGGGLRSLVGTPASSGLHSFEPHPIVGDAWEALRRSLVLFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDRAMLKPVLKRSASWTN

SEQ ID NO: 287 - DNA, 1785 bp, Sorghum bicolor
atggacgccggcaccgggggcggcgggccaacggccatccgcgtgccctaccgccacctccgcgacgccgagatggagctcgtcagcctcaacggagcggacgcgggcccgacgccgcacaaggacgcggaccagccgcggagccgcggcgccaacgccgacaggaccaagctcgtgcttgcctgcatggtcgccgcgggcgtccagttcgggtgggcactgcagctctccctcctcacgccatacatccagaccctaggaatagaccatgccatggcatcatttatttggctctgtgggccaataactggttttgtggttcaaccttgtgttggtgtttggagtgataagtgccgatcaaagtatgggaggagaaggccatttattttggctggatgcataatgatatgtgctgctgtaactttaatcgggttttctgcagacctcggttacatcttaggggataccaccgagcactgcagaacatataaaggttcaagatttcgagctgctatggttttcattctaggattctggatgttggacctggcaaacaatacagtgcaaggtcctgctcgtgctcttctagctgatctttcaggtcctgatcagtgtaattctgcaaatgcaatattctgctcatggatggctgttggaaatattcttggtttttcagctggtgcaagcggggattggcacaagtggtttccttttctaatgactagagcctgctgtgaagcttgtggtaatttgaaagcagctttcttagttgcagtcgtatttcttttgttctgtatgtctgttacgctgtacttcgctgaagagatcccactagagccaaaagatgcacaaggactgtcagattctgctcctctactgaacggttctagagaggatgcacatgcattgaatgaaccaaataatgaaagatttcctaatggccatgtagatggaaacaacgtgtcggctaacaacaacactgaggaatttccaaatgcgaattccaacacagacaatggaggagtcttcaatgatggacctggagcagttttggttaacattttgaccagcatgaggcatctacctcctgggatgcattcagtgcttgtagttatggccctaacatggttgtcatggtttcccttttttctttttgacactgactggatggggcgtgaagtttaccatggggatccaaatggagatctgagtgagaggaaagcttatgacaatggtgtccgagaaggtgcatttggtttgctattgaattcagttgtccttggcgttggttccttccttgttgatccactatgccggatgattggtgcaagattggtttgggccattagcaacttcactgtgtttatttgcatgatggctacaacaatactaagttggatctcttctgatctgtactcaagcaaactccatcacatcattggggcaaataaaacagtcaagactacagcattggttgttttctctcttctcggactgccactctcgatcacttatagcgttccattttctgtgactgctgagctgactgctggtacaggaggtggacaaggtctggccacaggagtcctaaatctcgctattgttgttccccagatagtagtgtcactcggagcaggtccatgggatgctctatatgggggaggaaacatcccagcgttcgccttggcttcggtcttctccctggcggcaggtgtgctcgcagttctcaagctaccaaagctgtcgaactcgtaccaatctgccggtttccatggatttggctga

SEQ ID NO: 288 - protein, 594 aa, Sorghum bicolor
MDAGTGGGGPTAIRVPYRHLRDAEMELVSLNGADAGPTPHKDADQPRSRGANADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAMVFILGFWMLDLANNTVQGPARALLADLSGPDQCNSANAIFCSWMAVGNILGFSAGASGDWHKWFPFLMTRACCEACGNLKAAFLVAVVFLLFCMSVTLYFAEEIPLEPKDAQGLSDSAPLLNGSREDAHALNEPNNERFPNGHVDGNNVSANNNTEEFPNANSNTDNGGVFNDGPGAVLVNILTSMRHLPPGMHSVLVVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKTTALVVFSLLGLPLSITYSVPFSVTAELTAGTGGGQGLATGVLNLAIVVPQIVVSLGAGPWDALYGGGNIPAFALASVFSLAAGVLAVLKLPKLSNSYQSAGFHGFG

SEQ ID NO: 289 - DNA, 1779 bp, Zea mays
atggacgccggcgccggggccacggccatccgagtgccctaccgccacctccgcgacgccgagatggagctcgtcagcctcaacggcggcgctcccggaggggacacgggcccgcccccgccaccgcccaaggaccagccgcggagccgcgccgacaggaccaagctcgtgctcgcctgcatggtcgccgcgggcgtccagttcggatgggcgctgcagctctccctccttacgccatacatccagaccctaggaatagaccatgccatggcatcatttatttggttgtgtgggcctataactggttttgtggttcaaccttgtgttggtgtttggagtgataagtgccgttcaaagtatgggaggagaagaccatttattttggctggatgcataatgatatgtgctgctgtaactctaatcgggttttctgcagacctcggttacatcttaggggacaccactgagcactgcagaacatataaaggttcaaggtttcgagctgctattgttttcattctaggattctggatgttggacctggcaaacaatacagtgcaaggtcctgcgcgtgctcttctagctgatctttcaggtcctgatcagtgcaattctgcaaatgcaatattctgctcatggatggctgttgggaatattcttggtttttcagctggagcgagtggggaatggcacaagtggtttccatttctaacgacaagagcatgctgtgaagcttgcggtaatttgaaagcagctttcttagttgcagttgtatttcttttgttatgtatgtctgttaccctgtacttcgctgaagagagcccactagatccaaaagatacacaaggactatcagattctgctcctctgctgaacggttctagagatgctgcccatgcatcaaatgaaccaaataatgaaagatttcctaatggccatgtgggtttaaacaatgtgtcggctaacaacaacactgaggaatttacaaatgtgaattccaacacagagaaaggaggagtcttcaatgatgggccaggagcagttttggttaacattttgaccagaatgaggcatctacctcctgggatgcattcagtgcttctagttatggccctaacatggttgtcatggtttccctttttcctttttgacactgactggatgggacgcgaagtttaccatggggatccaaatggagatttgagtgagaggaaagcttatgacaatggtgtccgagaaggtgcatttggtttgctattgaattcagttgtccttggcgttggttcattccttgttgatccactatgccggatgattggtgcaagattagtttgggccattagcaacttcacggtgtttatttgcatgatggctacaacgatattaagttggatctcttctgatctgtactcaagcaaacttcatcacatcatcggggcaaataaaacagtcaagatcacggcattggttgttttctctcttctcggattgccactctccatcacttacagcgttccgttttctgtgactgctgagctgactgccggtacaggaggtggacaaggtttggccacaggagtcctaaatcttgctatcgtggttccccagatagtagtgtcgcttggagcaggtccatgggacgctctgtatggaggagggaataccccggcgttcgtcttggcttcggtcttctccctggcagcaggtgtgctcgcagttctcaagctgccaaagctgtccaactcgtaccaatctgccgggttccatggatttggctga

SEQ ID NO: 290 - protein, 592 aa, Zea mays
MDAGAGATAIRVPYRHLRDAEMELVSLNGGAPGGDTGPPPPPPKDQPRSRADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAIVFILGFWMLDLANNTVQGPARALLADLSGPDQCNSANAIFCSWMAVGNILGFSAGASGEWHKWFPFLTTRACCEACGNLKAAFLVAVVFLLLCMSVTLYFAEESPLDPKDTQGLSDSAPLLNGSRDAAHASNEPNNERFPNGHVGLNNVSANNNTEEFTNVNSNTEKGGVFNDGPGAVLVNILTRMRHLPPGMHSVLLVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKITALVVFSLLGLPLSITYSVPFSVTAELTAGTGGGQGLATGVLNLAIVVPQIVVSLGAGPWDALYGGGNTPAFVLASVFSLAAGVLAVLKLPKLSNSYQSAGFHGFG

SEQ ID NO: 291 - DNA, 693 bp, Arabidopsis thaliana
atggcagacttgagtttttatgtcggagtcatagggaatgttatatcggtgcttgtcttcctctcccctgtggagacgttttggaggatagtgcagcggagatcgacggaggaatacgagtgttttccgtacatttgcacgttaatgagctcgtcgttatggacatattacggaatagtgacacctggtgaatacttggtttctactgtcaatggctttggtgctcttgctgaatccatctacgttctcattttcctcttctttgtccccaaatccagattcttgaaaacagttgttgtggttctagctttgaacgtgtgtttcccagttatcgcgattgcgggaacaagaactctgtttggagatgcaaactcgcgttctagttcaatgggtttcatatgtgctactctcaacattatcatgtatggttctcctctttcagctattaaaacggttgtgacgacgagaagtgtgcagtttatgccattttggttgtcatttttcctctttctgaacggcgcgatttggggtgtctacgctttactcctacacgatatgtttctactagtgccaaatggaatgggattctttcttgggataatgcaactcctaatttatgcctattacagaaatgccgaaccaattgtagaagatgaagaaggcctcataccaaatcaacctctcctcgcttaa

SEQ ID NO: 292 - protein, 230 aa, Arabidopsis thaliana
MADLSFYVGVIGNVISVLVFLSPVETFWRIVQRRSTEEYECFPYICTLMSSSLWTYYGIVTPGEYLVSTVNGFGALAESIYVLIFLFFVPKSRFLKTVVVVLALNVCFPVIAIAGTRTLFGDANSRSSSMGFICATLNIIMYGSPLSAIKTVVTTRSVQFMPFWLSFFLFLNGAIWGVYALLLHDMFLLVPNGMGFFLGIMQLLIYAYYRNAEPIVEDEEGLIPNQPLLA

SEQ ID NO: 293 - DNA, 4008 bp, Arabidopsis thaliana
atggataataacaattggaggccttctcttccaaacggagagcctgccatggatacaggtgactggagaacgcaattgccacctgattctcgtcagaagatcgtcaacaagataatggaaacactaaagaagcaccttccattttccggaccagagggaattaacgagctcaggagaattgcagctagattcgaggagaaaattttcagcggtgctcttaaccagactgattaccttcggaaaatatcaatgaagatgctgacaatggagactaaatcacaaaatgcagctggttcttccgcagctatccctgccgctaataatggcacatccatagattcgatacccaccaatcaaggccaacttcttccaggatcgttatcaaccaatcaatctcaagcacctcagccgttgctgtcccaaaccatgcagaataatactgcctctggaatgacgggttctactgctttaccatcttccatgccacctgtttcttccataaccaataataacaccacaagcgttgtgaaccagaatgccaatatgcaaaatgtagctggaatgttgcaagattcatctgggcagcatggcctttcctcgaacatgttttcaggaccccaaaggcagatgctgggtaggccacatgctatgtcttcacagcaacaacagcagccatatctttaccagcagcagctacagcagcaacttctcaagcagaacttccagtcagggaatgttcccaatcccaattcgcttttgccatcacacattcaacaacagcagcaaaatgtgctgcagcctaatcaactgcattcatctcaacaacctggtgttccaacatctgcgactcagccctccactgtgaactcagctcctctccaaggtctccacaccaatcagcaatcaagtccgcaattgtcttctcagcagacgacacaatctatgcttcgtcagcatcaatcgtcgatgctaaggcaacatccgcaatcacaacaagcctctggtatccatcagcagcaatcttcattgccgcaacaatcaatttctcctctacagcagcagcctacacaattaatgcggcaacaagctgcaaatagctcaggcatccaacagaagcagatgatggggcagcatgttgttggggatatgcagcagcaacatcagcaaaggttactgaaccaacaaaataatgttatgaacatacaacagcagcagtcgcagcagcaaccactgcagcagccacagcaacagcagaaacagcagccaccggcccagcagcagttgatgtctcaacaaaacagcctccaggcaacgcatcagaacccactgggcactcaaagcaatgttgcaggattgcagcaaccacaacaacagatgctcaattcccaggttggcaattcgagtttgcagaataaccagcactcggtgcacatgttatcacaaccaacggttgggctgcaacgaacacatcaggctggccatggcttgtattcttctcagggacaacagtcacaaaatcagccatcacaacagcagatgatgccacagcttcaatcgcatcatcagcagctgggtttgcaacaacaacctaatctgctacaacaggatgtgcaacaaaggctacaagcttcaggccaagtcactggttccctgcttccacctcaaaatgttgtggaccaacagagacaactatatcaatcccaaagaacccttccggagatgccatcatcatcgctggattcgacagcacagacggaaagtgcaaatggaggtgattggcaagaggaggtttaccaaaagatcaaatctatgaaagagacttacttaccagatctgaatgaaatctaccagagagttgcagcaaagttgcagcaagattctatgccacagcaacaaagatcagatcagcttgagaaactgagacaattcaaaacaatgttggagcgaatgatacaatttctatctgtttcaaagagcaacatcatgcccgcattaaaagataaggtggcttattatgagaagcagattataggtttcttaaatatgcacaggccgaggaagccagtacagcaagggcagcttccgcaatctcagatgcagcctatgcagcaaccacaatctcagacagttcaagatcaatcccatgataaccaaacaaatccgcagatgcaatcaatgagcatgcagggtgctgggccaagggcacaacagagtagtatgacaaatatgcagagcaatgttctatcatctcgtcctggagtttcagctccacagcagaacattcccagttccataccggcttctagtttagaatcaggccaaggaaataccttgaacaatggacagcaggttgccatgggatctatgcaacaaaatacttctcaactagtaaataacagttctgcctctgctcaaagtgggttgagcacactgcagtcgaatgtgaatcaaccccagttaagttccagtttgcttcagcatcagcacctcaagcaacagcaagatcaacaaatgcagctcaaacagcaatttcaacagcgccagatgcaacagcaacagttgcaagcaagacagcaacagcaacagcaacagttgcaagcaagacagcaagcggcacaattacagcagatgaatgatatgaatgatttaacatcgaggcaggggatgaatgtcagtcgtgggatgtttcagcaacattctatgcagggtcagcgtgcgaattatcctcttcaacagttaaaaccaggagctgtttcgtcgcctcaacttctgcaaggtgcatctcctcagatgtcacaacatttgtctcctcaggttgaccagaaaaatactgtcaacaagatgggaactccattgcaacctgcaaattccccttttgttgtcccatctccttcttcaacccccttggctccgtcccctatgcaagttgactctgagaaacctggttcttcttcgttgtcaatgggaaatattgcacgccaacaagcaaccggcatgcaaggtgtagttcagtccctagcaattggcactccagggatctctgcctctcctctccttcaggagtttactagtcctgatgggaatattttaaattcttcgacaattacatctggaaaaccgagtgctactgagctgcctattgaacgccttattagagccgtgaagtccatctcaccacaagccctttcttctgcagtaagtgacatcggatctgttgtaagcatggttgatcggatagctggttcagcaccaggaaacggttcaagagcttccgttggtgaagacttggttgcaatgactaagtgccgtctccaagcaagaaacttcatgacccaagagggaatgatggcgactaagaaaatgaagcgtcacacaaccgcaatgccactaagcgttgcttcactgggaggaagtgttggtgataactacaagcagtttgctggttcagaaacatccgatctagaatctactgcgacttcggatggcaagaaggcaagaactgagaccgagcatgcccttttggaggaaataaaggaaataaaccagcggctgatagatacagttgttgagataagtgatgatgaagatgctgctgatcctagtgaggttgcaatatcaagcatagggtgtgaaggaacaacagttagattctcgtttatagctgtttctctcagcccagccttgaaggctcatctctcatcaacacaaatgtctcctattcaaccattgcgtctgctggttccttgtagctaccccaatggctctccatctcttctagataaactcccggtcgaaaccagcaaagaaaacgaggacctgtcgtccaaagctatggcaaggttcaacatattgctaagaagtttgtcacagccgatgtcgctcaaagacatagccaagacatgggacgcctgtgctcgggcagtgatctgtgagtacgcacagcaatttggcggtggaactttcagctcaaaatacggcacttgggagaaatatgtagcagcttcctga

SEQ ID NO: 294 - protein, 1335 aa, Arabidopsis thaliana
MDNNNWRPSLPNGEPAMDTGDWRTQLPPDSRQKIVNKIMETLKKHLPFSGPEGINELRRIAARFEEKIFSGALNQTDYLRKISMKMLTMETKSQNAAGSSAAIPAANNGTSIDSIPTNQGQLLPGSLSTNQSQAPQPLLSQTMQNNTASGMTGSTALPSSMPPVSSITNNNTTSVVNQNANMQNVAGMLQDSSGQHGLSSNMFSGPQRQMLGRPHAMSSQQQQQPYLYQQQLQQQLLKQNFQSGNVPNPNSLLPSHIQQQQQNVLQPNQLHSSQQPGVPTSATQPSTVNSAPLQGLHTNQQSSPQLSSQQTTQSMLRQHQSSMLRQHPQSQQASGIHQQQSSLPQQSISPLQQQPTQLMRQQAANSSGIQQKQMMGQHVVGDMQQQHQQRLLNQQNNVMNIQQQQSQQQPLQQPQQQQKQQPPAQQQLMSQQNSLQATHQNPLGTQSNVAGLQQPQQQMLNSQVGNSSLQNNQHSVHMLSQPTVGLQRTHQAGHGLYSSQGQQSQNQPSQQQMMPQLQSHHQQLGLQQQPNLLQQDVQQRLQASGQVTGSLLPPQNVVDQQRQLYQSQRTLPEMPSSSLDSTAQTESANGGDWQEEVYQKIKSMKETYLPDLNEIYQRVAAKLQQDSMPQQQRSDQLEKLRQFKTMLERMIQFLSVSKSNIMPALKDKVAYYEKQIIGFLNMHRPRKPVQQGQLPQSQMQPMQQPQSQTVQDQSHDNQTNPQMQSMSMQGAGPRAQQSSMTNMQSNVLSSRPGVSAPQQNIPSSIPASSLESGQGNTLNNGQQVAMGSMQQNTSQLVNNSSASAQSGLSTLQSNVNQPQLSSSLLQHQHLKQQQDQQMQLKQQFQQRQMQQQQLQARQQQQQQQLQARQQAAQLQQMNDMNDLTSRQGMNVSRGMFQQHSMQGQRANYPLQQLKPGAVSSPQLLQGASPQMSQHLSPQVDQKNTVNKMGTPLQPANSPFVVPSPSSTPLAPSPMQVDSEKPGSSSLSMGNIARQQATGMQGVVQSLAIGTPGISASPLLQEFTSPDGNILNSSTITSGKPSATELPIERLIRAVKSISPQALSSAVSDIGSVVSMVDRIAGSAPGNGSRASVGEDLVAMTKCRLQARNFMTQEGMMATKKMKRHTTAMPLSVASLGGSVGDNYKQFAGSETSDLESTATSDGKKARTETEHALLEEIKEINQRLIDTVVEISDDEDAADPSEVAISSIGCEGTTVRFSFIAVSLSPALKAHLSSTQMSPIQPLRLLVPCSYPNGSPSLLDKLPVETSKENEDLSSKAMARFNILLRSLSQPMSLKDIAKTWDACARAVICEYAQQFGGGTFSSKYGTWEKYVAAS

SEQ ID NO: 295 - DNA, 3927 bp, Zea mays
atggacagcgccgccaactggcggtcaacgcagggcaccgaccctgccgccggcggcgtcgatccaaacgcggctgcccccgccggaagcgactggcgcacccagcttcagccagaggcgcgccacaggatcgtgaataagataatggagactctgaagaagcacctgccagtatcagtaccagaggggctgactgagcttcacaaaattgctgtgcgttttgaagagaaaatctatactgcagccaccagccagtctgattatttgcggaagatttcgctgaaaatgctgtccatggaaagtcagacaaagacacaacagaaccctggaaatgttcaagtgattccaaatcaaaaccctcctggtccagcacctggccttcctccacaagttagtaatccagcacagtcatcagctatcccattgatttctcagcaacagacacggcaatcaaatgcctctacatctgttcaaggttctcttcctagtcttggtcagaactcgtcgagtgtcagccaggcatcgacgctgcataatatgtctgtcatgccacaaaataccatgaacaatggtttagcacaaggtactccacaagatatgtatgctgcacaaaggcaaatggctggtaggcagcagcaacaacaacaacaacaagcacataatcagttaatttatcaacaacagaaatacttgaaccagaaattgcagcagaattcacttatgccatcgcacattcagcagcagcaacctttattgcagtcaacacagatgcaatcttcacagcagcccatgatgcaaatgtcatctggtcttcagcctgggcagactgccattccacaaactcagtccatgacgatgcattcagctacacaaagtggtattcaacaaaacccattgaattcagtacaacaatctgtgcaaccattactccatcagcctacacaatctgtagtgaggcagcagcaacatccacagtccatgcaccagcagtcttctctgcagcaaactcagccaactcaacagcccaacattcctttgcaacaacaacaaccacaattaatgaaccagcagtcaaatttacagcaaaatcagttaatgaatcaacagagtggtgttgtggagacgcaacagcaacaaaggctgccagttcagtcaaataatcttttgaatatgcagcaaacacagcagatgatgaaccagcaatctatgtccttgcaccagccacaacaattggcaaaccaaggaaatatgtcaagtctacatcagcagcagcatcagcaaaatcagcagcagcagcagcttctcggaactgggccaaatgcccgtatgcatatgttacagcagcaaaaggtaattcagcaaccacagcagcaacagcatgctcagcagacatcaatgggtttgatacaacctcagtctcagcagaaccaacttcagcaacctcagcaacatatgatgtcgcagttccagtctcagcctaatcaaatgcagcaacaattgggaatgcaacaaaggctccaaacttcagctggcatgctcttacaacaaaataacattgatcaaaagcaatatgttcaggcacagaggggccttcaagaagcacccagtacatctgtggattccactgctcaaactggtcatccaggcataggtgatttgcaagaggagttatatcaaatgattaagagtttaaaggaccaatactttgtggaattgaatgaattgtacaataaggtatctatcaagatacaacagattgacaaccaaatgcctgctcaaaagtcagcagagcagtatgaaaagatgaagggctttaaaggaatgctggagcgcactttgcatttcctgcaagttaacaagagcaacattcatccaggtttgagggaaaaaatccccatttacgagaggcaaattctcagtatcctaagttcacaaagaaggaaacctgtgcaggcacctgggcagcaaacgtttcagcaatctagtgggcaagctcctagctctaacatttcacagcaacttcagacttcccaaggtttgcagcagcatgatagtcatactagtcagatgcctcaagcaagtttaccaagtatgaacacaggagtacaaacctctggagcacctgcgcctcaaggaacaaactttggtgttccaacaacacagcaaaatgtcacaaatgcaccacaggctggctctaatttggagaatgctcagggaaataattttaatcatgtgcagcatggttcaatgggtgctgctttgcaacaggaaaggactggtcccatgcagggtgcattgaatgcacagcagcagtccagtagcaacatgatatccaacaatgcaatgagtacaatgcagactaataacaatgcaaatgcgaattcattgcagcagttaaagcagcaacgtcaggagcatcaaatgatgcaaagtcagcaaatgaagcagcgccagcagatgatgcaacagatacaacaaaagcaaacgcttcaaccgcagctcccaatacagcaactaaagaaacaacagcagcaagggcagatgcagtttccacagcttcattctggaaatgatgtgaatgagctaaaggttaggcaaggagctgcaatcaaatctggaatgtatcaacagctgagccagcgtaactattatcagcagataaaacagggtggtgtctttccaatttcttctccgcaaaccctccaaacatcgtccccacaaatttcacaccattctcctcaggttgatcagcacagtctgttgcaatctcaagtcaaaaccgggacaccattgcattcagctaactcaccatttgtcccatctccatcccctcctgtggccccatcaccgatgccaatggattcggataaaccactatccaacttatcttcagttactagtgctgggcaggctggacatcagcaaacatctcttgcacctcaaacacaatctatagccgttaacacaccaggtatatcagcgtcacccttgcttgcagaattcacaagtgctgatggaagtccggccaatgtaccaactcaagttccagccaaatcaagcgcagcagaaaggcctctggaccgtttgcttaaagcattgcgaacaacacagcgtgagtccctaagtgctgcagtcagcgatattggatctgtcgtgagtatgattgacaggattgctggatcagcgcctggtaatggttctagagctgctgtaggagaagatcttgtcgctatgacaaagtgccgcttgcaagccaggaacttcataactcatgacgggagtggtgcatcaaagaaaatgaagcgggacacgagtgctatgcctcttaatgtgtcatcagctggaagcgtgaatgatagcttgaagcaatcatatggtgttggtactccagagctacaatcaactgcaacctcacgtgtcaagtggcaaagggctgaggtaaaccatgctctgatggaggagattcaggagataaaccaacagcttatagatacagagctccatgtctctgaggatgatgctgagtccttcactacatctgaggggggcaaagggacggtcattagatgcacattcactgctgttgctgtttgccccagcttgaaatccgtgtttgcgtcagcgcagatgagtccaattttgccgttgaggttgcttgttcctgctagctacccgaaatgctccccggtgcttctagacaagtttcctgatgaacaatgcaggaactcagacgacctgtctaccaaggccaagacaaagttcagcgtattgctccggggtctagctgagcccatgtcactgcgagaaatcgcaaggacatgggatgcttgcgctcgcaaagtgatcacagagtatgcccagcaaaccggaggaggcagtttcagctcgagctatggttgctgggaaagctgcgtaggcgcttgttaa

SEQ ID NO: 296 - protein, 1308 aa, Zea mays
MDSAANWRSTQGTDPAAGGVDPNAAAPAGSDWRTQLQPEARHRIVNKIMETLKKHLPVSVPEGLTELHKIAVRFEEKIYTAATSQSDYLRKISLKMLSMESQTKTQQNPGNVQVIPNQNPPGPAPGLPPQVSNPAQSSAIPLISQQQTRQSNASTSVQGSLPSLGQNSSSVSQASTLHNMSVMPQNTMNNGLAQGTPQDMYAAQRQMAGRQQQQQQQQAHNQLIYQQQKYLNQKLQQNSLMPSHIQQQQPLLQSTQMQSSQQPMMQMSSGLQPGQTAIPQTQSMTMHSATQSGIQQNPLNSVQQSVQPLLHQPTQSVVRQQQHPQSMHQQSSLQQTQPTQQPNIPLQQQQPQLMNQQSNLQQNQLMNQQSGVVETQQQQRLPVQSNNLLNMQQTQQMMNQQSMSLHQPQQLANQGNMSSLHQQQHQQNQQQQQLLGTGPNARMHMLQQQKVIQQPQQQQHAQQTSMGLIQPQSQQNQLQQPQQHMMSQFQSQPNQMQQQLGMQQRLQTSAGMLLQQNNIDQKQYVQAQRGLQEAPSTSVDSTAQTGHPGIGDLQEELYQMIKSLKDQYFVELNELYNKVSIKIQQIDNQMPAQKSAEQYEKMKGFKGMLERTLHFLQVNKSNIHPGLREKIPIYERQILSILSSQRRKPVQAPGQQTFQQSSGQAPSSNISQQLQTSQGLQQHDSHTSQMPQASLPSMNTGVQTSGAPAPQGTNFGVPTTQQNVTNAPQAGSNLENAQGNNFNHVQHGSMGAALQQERTGPMQGALNAQQQSSSNMISNNAMSTMQTNNNANANSLQQLKQQRQEHQMMQSQQMKQRQQMMQQIQQKQTLQPQLPIQQLKKQQQQGQMQFPQLHSGNDVNELKVRQGAAIKSGMYQQLSQRNYYQQIKQGGVFPISSPQTLQTSSPQISHHSPQVDQHSLLQSQVKTGTPLHSANSPFVPSPSPPVAPSPMPMDSDKPLSNLSSVTSAGQAGHQQTSLAPQTQSIAVNTPGISASPLLAEFTSADGSPANVPTQVPAKSSAAERPLDRLLKALRTTQRESLSAAVSDIGSVVSMIDRIAGSAPGNGSRAAVGEDLVAMTKCRLQARNFITHDGSGASKKMKRDTSAMPLNVSSAGSVNDSLKQSYGVGTPELQSTATSRVKWQRAEVNHALMEEIQEINQQLIDTELHVSEDDAESFTTSEGGKGTVIRCTFTAVAVCPSLKSVFASAQMSPILPLRLLVPASYPKCSPVLLDKFPDEQCRNSDDLSTKAKTKFSVLLRGLAEPMSLREIARTWDACARKVITEYAQQTGGGSFSSSYGCWESCVGAC

SEQ ID NO: 297 - DNA, 747 bp, Arabidopsis thaliana
atggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatctcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcaggagcagatggatgaggcctga

SEQ ID NO: 298 - protein, 248 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 299 - DNA, 762 bp, Sorghum bicolor
atgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtag

SEQ ID NO: 300 - protein, 253 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAE

SEQ ID NO: 301 - DNA, 777 bp, Arabidopsis thaliana
atggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggtattcacatctctttatgccgtacctcgatattctacaccattcgaataa

SEQ ID NO: 302 - protein, 258 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQVFTSLYAVPRYSTPFE

SEQ ID NO: 303 - DNA, 762 bp, Sorghum bicolor; identical to SEQ ID NO: 299

SEQ ID NO: 304 - protein, 253 aa, Sorghum bicolor; identical to SEQ ID NO: 300

SEQ ID NO: 305 - protein, 145 aa, Sesamum indicum
MAEHYGQQQQTRAPHLQLQPRAQRVVKAATAVTAGGSLLVLSGLTLAGTVIALTIATPLLVIFSPVLVPAVITIFLLGAGFLASGGFGVAALSVLSWIYRYLTGKHPPGADQLESAKTKLASKAREMKDRAEQFSQQPVAGSQTS

SEQ ID NO: 306 - protein, 153 aa, Ficus pumila
MAEPQSLQRGERGEQLQLQLQQQQHPRSHQVVKAATAVTAGGSLLVLSALILAGTVIALTIATPLFVIFSPVLVPAVITLGLIIIGFLASGGFGVAALTVLSWIYRYVTGKHPPGADQLDQARHKLASKAREMKDKAEQFGQQHLTSGQQQSS

SEQ ID NO: 307 - protein, 142 aa, Cucumis sativus
MAEHQPYQQSHQQPGSQPRYQVVKAATAATAGGSLLVLSGLILAGTVIALTIATPLLVIFSPVLVPAVITVSLLIMGFLASGGFGVAGITVFSWIYRYVTGKHPPGADQLDLARHKLASKAREMKDRAEQFGQQHTSGPQTS

SEQ ID NO: 308 - protein, 155 aa, Linum usitatissimum
MDQSHQTYAGTMQNPSYGGGGTMHQQQQPRSYQAVKAATAATAGGSLIVLSGLILTATVISLILATPLLVIFSPVLVPALITVGLLITGFLASGGFGVAAVTVLSWIYRYVTGGHPVGADSLEQARSRLAGKAREVKDRASEFGQQHVTGGQQTS

SEQ ID NO: 309 - protein, 212 aa, Glycine max
MGFACKPCMKSLPTRAKPPPQVLPPKPPLTNFSIYTLITTTLNPTTLITHSSLKTLVFHFDNSHTMAELHYQQQHQYPHRYPNDPYEQQTSYSTQVVKAATAVTAGGSLLILASLILAGTIIALTIVTPPLVIFSPVLVPAVITVALLSLGFLASGGFGVAAITVLAWIYRYVTGKYPPGADQLDSAPHKIMDKAREIKDYGQQQISGVQAS

SEQ ID NO: 310 - protein, 149 aa, Ananas comosus
MADYQREQRGGGFMQGQQSQQQQQQQQPMMMTAVKAATAATAGGSMLVLSGLTLAGTVIALTVATPLLVIFSPVLVPATIAVSLLAAGFVTSGGLGLAALSVLSWMYKYLTGKHPPGADQLEHAKARLASKARDIKESAQHRIDQAQGS

SEQ ID NO: 311 - protein, 154 aa, Setaria italica
MADQHRGAMGGGGGGYGDLHRGGERGETQQRQSAMMTALKAATAATAGGSMLVLSGLILAGTVIALTVATPVLVIFSPVLVPAAITLALMAAGFVTSGGLGVAALSVFSWMYKYLTGKHPPGADQLDHAKARLASKARDIKDAAQHRIDQAQGS

SEQ ID NO: 312 - protein, 157 aa, Fragaria vesca
MAELHQQYQQSHPFQAQQGMMQQQPKSYQVAKAATAVTAGGSLLVLSGLVLAGTVICLTVATPLLVIFSPVLVPAVITVALIMTGFLASGGFGVAAISVLSWIYKYVTGSHPPGADKLDSARHKLAGKARDMKDRAEQFGQQHMGTERGQHGQHQTS

SEQ ID NO: 313 - protein, 170 aa, Brassica napus
MTDTARTHHDVTNRDQYSMMGRDRDQYNMYGRDYSKSRQIAKAVTAVTAGGSLLVLSSLTLVGTVIALTVATPLLVIFSPILVPALITVAMLITGFLSSGGFGIAAITVFSWIYKYATGEHPQGSDKLDSARMKLGSKAQDLKDRAQYYGQQHTGGEHDRDRTRGTQHTT

SEQ ID NO: 314 - protein, 147 aa, Solanum lycopersicum
MADYYGQPQHTQHQFFHGGQQPRSHQMVKAATAVTAGGSLLLLSGLTLAATVIALTIATPVLVIFSPVIVPAVITLFLLFSGFLASGGFGVAAVSVLSWIYRYVTGKRPPGADQLEQARHKLATKAGEMKDKAQEFGQQHITGTHQT

SEQ ID NO: 315 - protein, 163 aa, Vanilla planifolia
MADSQAGPRVPVVNGNGGIGGCHALLRRIHHHSPNSSQVVGFLTLALSGAILLLLIGITVIGATLGFIAFVPLLLMTSPVWVPLVSSAFVLLAGAAAFSGTAVATAAGVTWLYRYFTGRHPVGSDRVDYARSRIADTASHVKDYAREYGGYIQSRIKDAAPGA

SEQ ID NO: 316 - protein, 241 aa, Triadica sebifera; identical to SEQ ID NO: 228

SEQ ID NO: 317 - protein, 225 aa, Triadica sebifera
METEKKIPELKHLGFVRMAAIQSLICVSNLYDYAKHNSGPLRSTVGTVEGAVTTVVGPVYQKFKDLPDDVLVYVDKKVDEGTHKFDKHAPPIAKKAASQAHSLFHIALEKVEKLVQEARAGGPRAALHYVATESKHLALTQSVKLYIKLNQFPVIHTVTDVTLPTATHWSDKYNHTVMDLTRKGYTIFGYLPLVPIDDISKTFKQSKAEEKEKATTHKSDSSDSD

SEQ ID NO: 318 - protein, 236 aa, Triadica sebifera
MAESELNQHTDMVQDDDKKLKYLDFVQVAAIYVVVCFSSIYEYAKENSGPLKPGVQAVECTVKTVISPVYEKFRDVPFELLKFVDRKVDNSLGELDRHVPSLVKQASSQARAVASEIQHAGLVDATKNIAKTMYTKYELTAWQLYCKYKPVAKRYAVSTWRSLNQLPLFPQAAQIAIPTAASWSEKYNKMVRYTKDRGYPAAVYLPLISVERIAKVFNEDLNGPTVPTNGSSAAAQ

SEQ ID NO: 319 - protein, 371 aa, Cocos nucifera
MVELRSSSSEMDLDRPNIEEYLTTDSIQESPKKLHLRDLLDISPTLTEATGAIVDDSFTRCFKSNPPEPWNWNVYLFPLWCLGVIIRYGILFPLRVAILTAGWLVFFAAFIPVHFLLTAHNKWRRKIERKLVEMICSVFVASWTGVVKYHGPRPSMRPQQVFVANHTSMIDFIILEQMTAFAVIMQKHPGWVGFIQKTILEGVGCIWFNRTESKDREVVARKLREHIHGADNNPLLIFPEGTCVNNHYTVMFKKGAFELGCAVCPVAIKYNKIFVDAFWNSKKQSFTMHLFHLMTSWAVVCDVWYLEPQYIRPGETPIEFAERVRDMISVRAGLKKVPWDGYLKYFRPSPKLTERKQQIFAESVLQRLEEK

SEQ ID NO: 320 - protein, 389 aa, Zea mays
MGYIGHHGVATLRRYKYSGVDHSLVAKYILQPFWSRFVNIFPLWFPPNMITLTGFMFLLTSAFLGFLYSPHLDTAPPRWVHLAHGLLLFLYQTFDAVDGKQARRTNSSSPLGELFDHGCDALACAFESLAFGSTAMCGKATFWFWFISAVPFYFATWEHFFTNTLILPIVNGPTEGLMLIYLCHFFTFFTGAEWWAQDFQKSMPLLGWVPLISEIPVYDIVLCLMIAFAVIPTIGSNIHNVYKVVEARKGSMLLALAMLFPFGLLLAGVLVWSYLSPSDIMRTQPHLLIIGTGFAFGFLVGRMILAHLCDEPKGLKTGMCMSLAYFPFAIANALTARLDDGNPLVDEQLVLLMYCLFTVALYMHFATSVIHEITNALGIHCFRITRKKA

SEQ ID NO: 321 - protein, 393 aa, Zea mays
MGFIGAHGVETLKRYRYSGEDRSVVAKYVLQPFWSRCVTLFPLWMPPNMITLTGFSFLVLSALLGYICSPHLDTAPPRWVHLAHGLLLFLYQTFDAVDGKQARRTSSSSPLGELFDHGCDALACAFEALALGSTLMCGGWTLCFWVVAAVPFYLATWEHFFTNTLILPTINGPTEGLMLIYVSHLFTFFTGAEWWAQDFRKSLPFFGWIPLPFLSEIEIPLYVLVLILMIVCAVIPTVRSNVSNVQEVVEARKGSMALALAMILPFIVLLAGVAIWCYLSPSSIMRNQPHLLVIGTGFNFGYLVGRMILAHLCDEPKGLKSGMFMSLVFLCFPIANALIAKINDGSPLVDELVLLLLYCAYTVGLYLHLAVSVVHEIKDALGIYCFRITRKEA

SEQ ID NO: 322 - protein, 389 aa, Sorghum bicolor
MGYIGHHGVATLRRYKYSGVDHSLVAKYILQPFWSRFVNIFPLWFPPNMITLTGFMFLLTSAFLGFLYSPHLDTAPPRWVHLAHGLLLFLYQTFDAVDGKQARRTNSSSPLGELFDHGCDALACAFESLAFGSTAMCGKATFWFWFISAVPFYFATWEHFFTNTLILPIVNGPTEGLMLIYLCHFFTFFTGAKWWAQDFQKSMPLLGWVPFISEIPVYDIVLCLMIAFAVIPTIASNIHNVYKVVEARKGSMVLALAMLFPFGLLLAGVLVWSYFSPSDIMRNQPHLLIIGTGFAFGFLVGRMILAHLCDEPKGLKTGMCMSLAYFPFAIANALTARLDDGNPLVDEQLVLLMYCLFTVALYMHFATSVIHEITNALGIHCFRITTKKA

SEQ ID NO: 323 - protein, 393 aa, Sorghum bicolor
MGFIGAHGVETLKRYRYSGEDRSVVAKYVLQPFWSRCVTLFPLWMPPNMITLTGFSFLVLSALLGYIYSPRLDTAPPRWVHLAHGLLLFLYQTFDAVDGKQARRTSSSSPLGELFDHGCDALACAFEALALGSTLMCGGWTFWFWVVAAVPFYLATWEHFFTNTLILPTINGPTEGLMLIYVSHLFTFLTGAEWWAQDFRKSLPFLGWIPLPFLSEIKIPLYVLVLILMIVCAVIPTVRSNVSNVQEVVETRKGSMALALAMILPFITLLAGVAIWSYLSPSSIMRNQPHLLVIGTGFNFGYLVGRMILAHLCDEPKGLKSGMFMSLVFLCFPIANALIAKINNGTPLVDELVLLLLYCAYTVGLYLHLAVSVVHEIKDALGIYCFRITRKEA

---

The invention claimed is:

1. A process for producing a feedstuff for an animal, the process comprising a step of:
   (i) harvesting vegetative plant parts from a transgenic *Sorghum* species plant or a transgenic *Zea mays* plant, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the *Sorghum* species or *Zea mays* vegetative plant parts and increase the level of the WRI1 polypeptide relative to a corresponding wild type vegetative plant part, and (b) a second exogenous polynucleotide which encodes a plant diacylglycerol acyltransferase (DGAT) polypeptide operably linked to a heterologous promoter which is effective to direct expression of the second exogenous polynucleotide in the *Sorghum* species or *Zea mays* vegetative plant parts and increase the level of the DGAT polypeptide relative to the corresponding wild type vegetative plant part, whereby the vegetative plant parts comprise a total fatty acid (TFA) content which comprises fatty acids esterified in the form of triacylglycerols (TAG) and fatty acids in the form of lipids other than TAG, wherein the vegetative plant parts comprise a TFA content of between 6% and 20% (w/w dry weight) and a TAG/TFA Quotient (TTQ) of between 0.60 and 0.84, or between 0.84 and 0.95, and one or more of the following steps:

(ii) admixing the harvested plant parts with at least one other feed ingredient, (iii) baling the harvested plant parts, (iv) processing the harvested plant parts by chopping, cutting, drying, pressing or pelleting the plant parts, and (v) storing the harvested plant parts under conditions of reduced oxygen for a period of time until at least some carbohydrates in the plant parts are fermented to organic acids.

2. A process for feeding an animal, the process comprising providing vegetative plant parts from a transgenic *Sorghum* species plant or a transgenic *Zea mays* plant to the animal, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the *Sorghum* species or *Zea mays* vegetative plant parts and increase the level of the WRI1 polypeptide relative to a corresponding wild type vegetative plant part, (b) a second exogenous polynucleotide which encodes a plant diacylglycerol acyltransferase (DGAT) polypeptide operably linked to a heterologous promoter which is effective to direct expression of the second exogenous polynucleotide in the *Sorghum* species or *Zea mays* vegetative plant parts and increase the level of the DGAT polypeptide relative to the corresponding wild type vegetative plant part, whereby the vegetative plant parts comprise a total fatty acid (TFA) content which comprises fatty acids esterified in the form of triacylglycerols (TAG) and fatty acids in the form of lipids other than TAG, wherein the vegetative plant parts comprise a TFA content of between 6% and 20% (w/w dry weight) and a TAG/TFA Quotient (TTQ) of between 0.60 and 0.84, or between 0.84 and 0.95.

3. The process of claim 2, wherein one or more or all of the following features apply:

(i) the vegetative plant parts are comprised in a *Sorghum* species plant or *Zea mays* plant growing in a field, (ii) the vegetative plant parts are harvested from the *Sorghum* species plant or *Zea mays* plant and admixed with at least one other feed ingredient, (iii) the vegetative plant parts are processed post-harvest by chopping, cutting, drying, pressing or pelleting the plant parts, (iv) the harvested plant parts are stored under conditions of reduced oxygen for a period of time until at least some carbohydrates in the plant parts are fermented to organic acids prior to being provided to the animal, and (v) the harvested plant parts are stored for a period of time between harvest and providing them to the animal.

4. A transgenic feedstuff produced by the process of claim 1, comprising harvested vegetative plant parts from a transgenic *Sorghum* species plant or a transgenic *Zea mays* plant, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the *Sorghum* species or *Zea mays* vegetative plant parts and increase the level of the WRI1 polypeptide relative to a corresponding wild type vegetative plant part, and (b) a second exogenous polynucleotide which encodes a plant diacylglycerol acyltransferase (DGAT) polypeptide operably linked to a heterologous promoter which is effective to direct expression of the second exogenous polynucleotide in the *Sorghum* species or *Zea mays* vegetative plant parts and increase the level of the DGAT polypeptide relative to a corresponding wild type vegetative plant part, whereby the vegetative plant parts comprise a total fatty acid (TFA) content which comprises fatty acids esterified in the form of triacylglycerols (TAG) and fatty acids in the form of lipids other than TAG, wherein the vegetative plant parts comprise a TFA content of between 6% and 20% (w/w dry weight) and a TAG/TFA Quotient (TTQ) of between 0.60 and 0.84, or between 0.84 and 0.95, wherein (i) the harvested plant parts are mixed with at least one other feed ingredient, (ii) the harvested plant parts are baled after harvest, (iii) the harvested plant parts are processed by chopping, cutting, drying, pressing or pelleting the plant parts, or (iv) the harvested plant parts are stored under conditions of reduced oxygen for a period of time until at least some carbohydrates in the plant parts are fermented to organic acids, and wherein said feedstuff and said harvested vegetative plant parts comprise said transgenic first exogenous polynucleotide and said transgenic second exogenous polynucleotide.

5. The transgenic feedstuff of claim 4 which is silage, pellets or hay, and wherein said silage, pellets and hay comprise said transgenic first exogenous polynucleotide and said transgenic second exogenous polynucleotide.

6. The process of claim 1, wherein the vegetative plant parts are further transgenic for at least an exogenous polynucleotide which encodes an RNA molecule which is complementary to a portion of an mRNA molecule encoding an endogenous Sugar Dependent 1 (SDP1) TAG lipase polypeptide and which down-regulates production of the endogenous SDP1 TAG lipase polypeptide in the *Sorghum* species or *Zea mays* vegetative plant parts, wherein the exogenous polynucleotide is operably linked to a heterologous promoter which is effective to direct expression of the exogenous polynucleotide in the *Sorghum* species or *Zea mays* vegetative plant parts and the RNA molecule down-regulates production of the endogenous SDP1 TAG lipase polypeptide relative to a corresponding wild type vegetative plant part.

7. A transgenic *Sorghum* species plant or transgenic *Zea mays* plant, or a vegetative part thereof, being transgenic for at least (a) a first exogenous polynucleotide which encodes a plant WRI1 polypeptide operably linked to a heterologous promoter which is effective to direct expression of the first exogenous polynucleotide in the *Sorghum* species plant or *Zea mays* plant or part thereof and increase the level of the WRI1 polypeptide relative to a corresponding wild type plant or part thereof, and (b) a second exogenous polynucleotide which encodes a plant DGAT polypeptide operably linked to a heterologous promoter which is effective to direct expression of the second exogenous polynucleotide in the *Sorghum* species plant or *Zea mays* plant or part thereof and increase the level of the DGAT polypeptide relative to the corresponding wild type plant or part thereof, whereby said vegetative part of said transgenic *Sorghum* species plant or said vegetative part of said transgenic *Zea mays* plant comprises a total fatty acid (TFA) content which comprises fatty acids esterified in the form of triacylglycerols (TAG) and fatty acids in the form of lipids other than TAG, wherein said vegetative plant part comprises a TFA content of between 6% and 20% (w/w dry weight) and a TAG/TFA Quotient (TTQ) of between 0.60 and 0.84, or between 0.84 and 0.95, and wherein said transgenic *Sorghum* species plant or said transgenic *Zea mays* plant comprising said vegetative plant part comprising one or more of:

(i) an exogenous polynucleotide which encodes an RNA molecule which is complementary to a portion of an mRNA molecule encoding an endogenous SDP1 TAG lipase polypeptide and which down-regulates production of the endogenous SDP1 TAG lipase polypeptide in the *Sorghum* species or *Zea mays* vegetative plant part, wherein the exogenous polynucleotide is operably linked to a heterologous promoter which is effective to direct expression of the exogenous polynucleotide in the *Sorghum* species or *Zea mays* vegetative plant part and the RNA molecule down-regulates production of the endogenous SDP1 TAG lipase polypeptide relative to a corresponding wild type vegetative plant part;

(ii) an exogenous polynucleotide which encodes a plant LEC2 polypeptide operably linked to a heterologous promoter which is effective to direct expression of the exogenous polynucleotide in the *Sorghum* species or *Zea mays* vegetative plant part and increase the level of the LEC2 polypeptide relative to the corresponding wild type vegetative plant part;

(iii) an exogenous polynucleotide which encodes a plant PDAT polypeptide operably linked to a heterologous promoter which is effective to direct expression of the exogenous polynucleotide in the *Sorghum* species or *Zea mays* vegetative plant part and increase the level of the PDAT polypeptide relative to the corresponding wild type vegetative plant part, an another exogenous polynucleotide which encodes an RNA molecule which is complementary to a portion of an mRNA molecule encoding an endogenous TGD5 polypeptide and which down-regulates production of the endogenous TGD5 polypeptide in the *Sorghum* species or *Zea mays* vegetative plant part, wherein said another exogenous polynucleotide is operably linked to a heterologous promoter which is effective to direct expression of said another exogenous polynucleotide in the *Sorghum* species or *Zea mays* vegetative plant part and the RNA molecule down-regulates production of the endogenous TGD5 polypeptide relative to the corresponding wild type vegetative plant part, and an additional exogenous polynucleotide which encodes an RNA molecule which is complementary to a portion of an mRNA molecule encoding an endogenous SDP1 TAG lipase polypeptide and which down-regulates production of the endogenous SDP1 TAG lipase polypeptide in the *Sorghum* species or *Zea mays* vegetative plant part, wherein said additional exogenous polynucleotide is operably linked to a heterologous promoter which is effective to direct expression of said additional exogenous polynucleotide in the *Sorghum* species or *Zea mays* vegetative plant part and the RNA molecule down-regulates production of the endogenous SDP1 TAG lipase polypeptide relative to the corresponding wild type vegetative plant part;

and (iv) an exogenous polynucleotide which encodes an RNA molecule which is complementary to a portion of an mRNA molecule encoding an endogenous SDP1 TAG lipase polypeptide and which down-regulates production of the endogenous SDP1 TAG lipase in the *Sorghum* species or *Zea mays* vegetative plant part, wherein the exogenous polynucleotide is operably linked to a heterologous promoter which is effective to direct expression of the exogenous polynucleotide in the *Sorghum* species or *Zea mays* vegetative plant part and the RNA molecule down-regulates production of the endogenous SDP1 TAG lipase polypeptide relative to the corresponding wild type vegetative plant part, an another exogenous polynucleotide which encodes an RNA molecule which is complementary to a portion of an mRNA molecule encoding an endogenous TGD5 polypeptide and which down-regulates production of the endogenous TGD5 polypeptide in the *Sorghum* species or *Zea mays* vegetative plant part, wherein said another exogenous polynucleotide is operably linked to a heterologous promoter which is effective to direct expression of said another exogenous polynucleotide in the *Sorghum* species or *Zea mays* vegetative plant part and the RNA molecule down-regulates production of the endogenous TGD5 polypeptide relative to the corresponding wild type vegetative plant part, and an additional exogenous polynucleotide which encodes an RNA molecule which is complementary to a portion of an mRNA molecule encoding an endogenous TST1 polypeptide and which down-regulates production of the endogenous TST1 polypeptide in the *Sorghum* species or *Zea mays* vegetative plant part wherein said additional exogenous polynucleotide is operably linked to a heterologous promoter which is effective to direct expression of said additional exogenous polynucleotide in the *Sorghum* species or *Zea mays* vegetative plant part and the RNA molecule down-regulates production of the endogenous TST1 polypeptide relative to the corresponding wild type vegetative plant part.

8. A process for producing transgenic seed, the process comprising:
   i) growing said transgenic *Sorghum* species plant or said transgenic *Zea mays* plant of claim 7, and
   ii) harvesting transgenic seed from said transgenic *Sorghum* species plant or said transgenic *Zea mays* plant.

9. The process of claim 1, wherein the transgenic vegetative plant parts have a TAG/TFA Quotient (TTQ) of between 0.60 and 0.84.

10. The process of claim 1, wherein the transgenic vegetative plant parts have a TAG/TFA Quotient (TTQ) of between 0.84 and 0.95.

11. The process of claim 2, wherein the transgenic vegetative plant parts have a TAG/TFA Quotient (TTQ) of between 0.60 and 0.84.

12. The process of claim 2, wherein the transgenic vegetative plant parts have a TAG/TFA Quotient (TTQ) of between 0.84 and 0.95.

13. A process for producing a transgenic feedstuff for an animal, the process comprising a step of:
   (i) harvesting vegetative plant parts from a transgenic *Sorghum* species plant or a transgenic *Zea mays* plant, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the *Sorghum* species or *Zea mays* vegetative plant parts and increase the level of the WRI1 polypeptide relative to a corresponding wild type vegetative plant part, and (b) a second exogenous polynucleotide which encodes a plant diacylglycerol acyltransferase (DGAT) polypeptide operably linked to a heterologous promoter which is effective to direct expression of the second exogenous polynucleotide in the *Sorghum* species or *Zea mays* vegetative plant parts and increase the level of the DGAT polypeptide relative to a corresponding wild type vegetative plant part, whereby the transgenic vegetative plant parts comprise a total fatty acid (TFA) content which comprises fatty acids esterified in the form of triacylglycerols (TAG) and fatty acids in the form of lipids other than TAG, wherein the transgenic vegetative plant parts comprise a TFA content of between 6% and 20% (w/w dry weight) and a TAG/TFA Quotient (TTQ) of between 0.01 and 0.60, and one or more of the following steps:

(ii) admixing the harvested transgenic plant parts with at least one other feed ingredient, (iii) baling the harvested transgenic plant parts, (iv) processing the harvested transgenic plant parts by chopping, cutting, drying, pressing or pelleting the transgenic plant parts, and (v) storing the harvested transgenic plant parts under conditions of reduced oxygen for a period of time such that at least some of carbohydrates in the transgenic plant parts are fermented to organic acids.

14. A transgenic feedstuff produced by the process of claim 13, comprising harvested vegetative plant parts from said transgenic Sorghum species plant or said transgenic Zea mays plant, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the Sorghum species or Zea mays vegetative plant parts and increase the level of the WRI1 polypeptide relative to a corresponding wild type plant or part thereof, and (b) a second exogenous polynucleotide which encodes a plant diacylglycerol acyltransferase (DGAT) polypeptide operably linked to a heterologous promoter which is effective to direct expression of the second exogenous polynucleotide in the Sorghum species or Zea mays vegetative plant parts and increase the level of the DGAT polypeptide relative to the corresponding wild type plant or part thereof, whereby the transgenic vegetative plant parts comprise a total fatty acid (TFA) content which comprises fatty acids esterified in the form of triacylglycerols (TAG) and fatty acids in the form of lipids other than TAG, wherein the transgenic vegetative plant parts comprise a TFA content of between 6% and 20% (w/w dry weight) and a TAG/TFA Quotient (TTQ) of between 0.01 and 0.60, and wherein (i) the transgenic harvested plant parts are mixed with at least one other feed ingredient, (ii) the transgenic harvested plant parts are baled after harvest, (iii) the transgenic harvested plant parts are processed by chopping, cutting, drying, pressing or pelleting the plant parts, or iv) the transgenic harvested plant parts are stored under conditions of reduced oxygen for a period of time until at least some of carbohydrates in the plant parts are fermented to organic acids.

15. A process for feeding an animal, the process comprising providing transgenic vegetative plant parts from a transgenic Sorghum species plant or a transgenic Zea mays plant to the animal, the vegetative plant parts being transgenic for at least (a) a first exogenous polynucleotide which encodes a plant Wrinkled 1 (WRI1) polypeptide operably linked to a heterologous promoter which is effective to direct expression of the first exogenous polynucleotide in the Sorghum species or Zea mays vegetative plant parts and increase the level of the WRI1 polypeptide relative to a corresponding wild type plant or part thereof, and (b) a second exogenous polynucleotide which encodes a plant diacylglycerol acyltransferase (DGAT) polypeptide operably linked to a heterologous promoter which is effective to direct expression of the second exogenous polynucleotide in the transgenic Sorghum species plant or transgenic Zea mays vegetative plant parts and increase the level of the DGAT polypeptide relative to a corresponding wild type plant or part thereof, whereby the transgenic vegetative plant parts comprise a total fatty acid (TFA) content which comprises fatty acids esterified in the form of triacylglycerols (TAG) and fatty acids in the form of lipids other than TAG, wherein the transgenic vegetative plant parts comprise a TFA content of between 6% and 20% (w/w dry weight) and a TAG/TFA Quotient (TTQ) of between 0.01 and 0.60.

16. The process of claim 1, wherein the vegetative plant parts are further transgenic for at least an exogenous polynucleotide which encodes a plant Leafy Cotyledon 2 (LEC2) polypeptide operably linked to a heterologous promoter which is effective to direct expression of the exogenous polynucleotide in the Sorghum species or Zea mays vegetative plant parts and increase the level of the LEC2 polypeptide relative to the corresponding wild type vegetative plant part.

17. The process of claim 1, wherein the vegetative plant parts are further transgenic for at least an exogenous polynucleotide which encodes a plant phospholipid:diacylglycerol acyltransferase (PDAT) polypeptide operably linked to a heterologous promoter which is effective to direct expression of the exogenous polynucleotide in the Sorghum species or Zea mays vegetative plant parts and increase the level of the PDAT polypeptide relative to the corresponding wild type vegetative plant part, an another exogenous polynucleotide which encodes an RNA molecule which is complementary to a portion of an mRNA molecule encoding an endogenous trigalactosyldiacylglycerol 5 (TGD5) polypeptide and which down-regulates production of the endogenous TGD5 polypeptide in the Sorghum species or Zea mays vegetative plant parts, wherein the another exogenous polynucleotide is operably linked to a heterologous promoter which is effective to express the another exogenous polynucleotide in the Sorghum species or Zea mays vegetative plant parts and the RNA molecule down-regulates production of the endogenous TGD5 polypeptide relative to the corresponding wild type vegetative plant part, and an additional exogenous polynucleotide which encodes an RNA molecule which is complementary to a portion of an mRNA molecule encoding an endogenous SDP1 TAG lipase polypeptide and which down-regulates production of the endogenous SDP1 TAG lipase polypeptide in the Sorghum species or Zea mays vegetative plant parts, wherein the additional exogenous polynucleotide is operably linked to a heterologous promoter which is effective to express the additional exogenous polynucleotide in the Sorghum species or Zea mays vegetative plant parts and the RNA molecule down-regulates production of the endogenous SDP1 TAG lipase polypeptide relative to the corresponding wild type vegetative plant part.

18. The process of claim 1, wherein the vegetative plant parts are further transgenic for at least an exogenous polynucleotide which encodes an RNA molecule which is complementary to a portion of an mRNA molecule encoding an endogenous SDP1 TAG lipase polypeptide and which down-regulates production of the endogenous SDP1 TAG lipase in the Sorghum species or Zea mays vegetative plant parts, wherein the exogenous polynucleotide is operably linked to a heterologous promoter which is effective to express the exogenous polynucleotide in the Sorghum species or Zea mays vegetative plant parts and the RNA molecule down-regulates production of the endogenous SDP1 TAG lipase polypeptide relative to the corresponding wild type vegetative plant part, an another exogenous polynucleotide which encodes an RNA molecule which is complementary to a portion of an mRNA molecule encoding an endogenous TGD5 polypeptide and which down-regulates production of the endogenous TGD5 polypeptide in the *Sorghum* species or *Zea mays* vegetative plant parts, wherein the exogenous polynucleotide is operably linked to a heterologous promoter which is effective to express the another exogenous polynucleotide in the *Sorghum* species or *Zea mays* vegetative plant parts and the RNA molecule down-regulates production of the endogenous TGD5 polypeptide relative to the corresponding wild type vegetative plant part, and an additional exogenous polynucleotide which encodes an RNA molecule which is complementary to a portion of an mRNA molecule encoding an endogenous TST1 polypeptide and which down-regulates production of the endogenous TST1 polypeptide in the *Sorghum* species or *Zea mays* vegetative plant parts, wherein the additional exogenous polynucleotide is operably linked to a heterologous promoter which is effective to direct expression of the additional exogenous polynucleotide in the *Sorghum* species or *Zea mays* vegetative plant parts and the RNA molecule down-regulates production of the endogenous TST1 polypeptide relative to the corresponding wild type vegetative plant part.

19. The transgenic *Sorghum* species plant or transgenic *Zea mays* plant or a vegetative part thereof of claim 7, wherein the plant or vegetative part thereof is transgenic for said exogenous polynucleotide which encodes an RNA molecule which is complementary to a portion of an mRNA molecule encoding an endogenous SDP1 TAG lipase polypeptide and which down-regulates production of the endogenous SDP1 TAG lipase polypeptide in the *Sorghum* species or *Zea mays* vegetative plant part.

20. The transgenic *Sorghum* species plant or transgenic *Zea mays* plant or a vegetative part thereof of claim 7, wherein the plant or vegetative part thereof is transgenic for said exogenous polynucleotide which encodes a plant LEC2 polypeptide operably linked to a heterologous promoter which is effective to direct expression of the exogenous polynucleotide in the *Sorghum* species or *Zea mays* vegetative plant part and increase the level of the LEC2 polypeptide relative to the corresponding wild type vegetative plant part.

21. The transgenic *Sorghum* species plant or transgenic *Zea mays* plant or a vegetative part thereof of claim 7, wherein the plant or vegetative part thereof is transgenic for said exogenous polynucleotide which encodes a plant PDAT polypeptide operably linked to a heterologous promoter which is effective to direct expression of the exogenous polynucleotide in the *Sorghum* species or *Zea mays* vegetative plant part and increase the level of the PDAT polypeptide relative to the corresponding wild type vegetative plant part, said another exogenous polynucleotide which encodes an RNA molecule which is complementary to a portion of an mRNA molecule encoding an endogenous TGD5 polypeptide and which down-regulates production of the endogenous TGD5 polypeptide in the *Sorghum* species or *Zea mays* vegetative plant part, and said additional exogenous polynucleotide which encodes an RNA molecule which is complementary to a portion of an mRNA molecule encoding an endogenous SDP1 TAG lipase polypeptide and which down-regulates production of the endogenous SDP1 TAG lipase polypeptide in the *Sorghum* species or *Zea mays* vegetative plant part.

22. The transgenic *Sorghum* species plant or transgenic *Zea mays* plant or a vegetative part thereof of claim 7, wherein the plant or vegetative part thereof is transgenic for said exogenous polynucleotide which encodes an RNA molecule which is complementary to a portion of an mRNA molecule encoding an endogenous SDP1 TAG lipase polypeptide and which down-regulates production of the endogenous SDP1 TAG lipase in the *Sorghum* species or *Zea mays* vegetative plant part, said another exogenous polynucleotide which encodes an RNA molecule which is complementary to a portion of an mRNA molecule encoding an endogenous TGD5 polypeptide and which down-regulates production of the endogenous TGD5 polypeptide in the *Sorghum* species or *Zea mays* vegetative plant part, and said additional exogenous polynucleotide which encodes an RNA molecule which is complementary to a portion of an mRNA molecule encoding an endogenous TST1 polypeptide and which down-regulates production of the endogenous TST1 polypeptide in the *Sorghum* species or *Zea mays* vegetative plant.

23. The process of claim 1, wherein the vegetative plant parts are from a transgenic *Sorghum* species plant.

24. The process of claim 2, wherein the vegetative plant parts are from a transgenic *Sorghum* species plant.

25. The transgenic feedstuff of claim 4, wherein the vegetative plant parts are from a transgenic *Sorghum* species plant.

26. The process of claim 6, wherein the vegetative plant parts are from a transgenic *Sorghum* species plant.

27. The transgenic plant or vegetative part thereof of claim 7, wherein the transgenic plant or vegetative part thereof is a transgenic *Sorghum* species plant or vegetative part thereof.

28. The process of claim 8, wherein the transgenic seed are from a transgenic *Sorghum* species plant.

29. The process of claim 13, wherein the vegetative plant parts are from a transgenic *Sorghum* species plant.

30. The transgenic feedstuff of claim 14, wherein the vegetative plant parts are from a transgenic *Sorghum* species plant.

31. The process of claim 15, wherein the vegetative plant parts are from a transgenic *Sorghum* species plant.

32. The process of claim 16, wherein the vegetative plant parts are from a transgenic *Sorghum* species plant.

33. The transgenic plant or vegetative part thereof of claim 19, wherein the transgenic plant or vegetative part thereof is a transgenic *Sorghum* species plant or vegetative part thereof.

34. The transgenic plant or vegetative part thereof of claim 20, wherein the transgenic plant or vegetative part thereof is a transgenic *Sorghum* species plant or vegetative part thereof.

35. The transgenic plant or vegetative part thereof of claim 21, wherein the transgenic plant or vegetative part thereof is a transgenic *Sorghum* species plant or vegetative part thereof.

36. The transgenic plant or vegetative part thereof of claim 22, wherein the transgenic plant or vegetative part thereof is a transgenic *Sorghum* species plant or vegetative part thereof.

* * * * *